US009752144B2

(12) United States Patent
Montgomery et al.

(10) Patent No.: US 9,752,144 B2
(45) Date of Patent: Sep. 5, 2017

(54) INHIBITORS OF MYH7B AND USES THEREOF

(71) Applicant: MiRagen Therapeutics, Inc., Boulder, CO (US)

(72) Inventors: Rusty Montgomery, Boulder, CO (US); Christina Dalby, Boulder, CO (US)

(73) Assignee: MIRAGEN THERAPEUTICS, INC., Boulder, CO (US)

(*) Notice: Subject to any disclaimer, the term of this patent is extended or adjusted under 35 U.S.C. 154(b) by 0 days.

(21) Appl. No.: 14/818,144

(22) Filed: Aug. 4, 2015

(65) Prior Publication Data

US 2016/0032286 A1 Feb. 4, 2016

Related U.S. Application Data

(60) Provisional application No. 62/033,018, filed on Aug. 4, 2014.

(51) Int. Cl.
| | | |
|---|---|---|
| *C12N 15/11* | (2006.01) | |
| *C12N 15/113* | (2010.01) | |
| *A61K 31/713* | (2006.01) | |
| *A61K 31/7105* | (2006.01) | |
| *A61K 45/06* | (2006.01) | |

(52) U.S. Cl.
CPC .......... *C12N 15/113* (2013.01); *A61K 31/713* (2013.01); *A61K 31/7105* (2013.01); *A61K 45/06* (2013.01); *C12N 2310/11* (2013.01); *C12N 2310/315* (2013.01); *C12N 2310/321* (2013.01); *C12N 2310/322* (2013.01); *C12N 2310/3231* (2013.01); *C12N 2310/3341* (2013.01); *C12N 2310/341* (2013.01); *C12N 2310/346* (2013.01)

(58) Field of Classification Search
CPC ............ C12N 15/1136; C12N 2310/11; C12N 2310/32
See application file for complete search history.

(56) References Cited

U.S. PATENT DOCUMENTS

| | | | | |
|---|---|---|---|---|
| 7,517,644 | B1* | 4/2009 | Smith ................ | C12Q 1/6886 435/375 |
| 8,090,542 | B2* | 1/2012 | Khvorova ............ | A61K 31/713 435/6.1 |
| 2003/0088079 | A1* | 5/2003 | Manoharan ............ | C07H 19/04 536/23.1 |
| 2005/0255487 | A1 | 11/2005 | Khvorova et al. | |
| 2012/0184596 | A1* | 7/2012 | Dalby ................ | A61K 31/7105 514/44 A |
| 2013/0116301 | A1* | 5/2013 | Freier ................ | C12N 15/1138 514/44 A |
| 2013/0158096 | A1* | 6/2013 | Reijerkerk ............ | C12N 15/113 514/44 A |
| 2013/0331433 | A1 | 12/2013 | Thibonnier | |
| 2013/0344135 | A1 | 12/2013 | Van Rooij et al. | |
| 2014/0179621 | A1* | 6/2014 | Patel ................ | A61K 31/4412 514/20.8 |

FOREIGN PATENT DOCUMENTS

| | | | |
|---|---|---|---|
| WO | WO2009/043353 A2 | * | 4/2009 |
| WO | WO 2012/140234 A1 | | 10/2012 |

OTHER PUBLICATIONS

Rubio et al. The Journal of Neuroscience, 2011, 31:1448-1460.*
Yeung et al. Nucleic Acids Research 2012 40:7303-7318.*
NCBI BLAST sequence comparison, NM_020884.4 vs. NM_001107794.2, retrieved online May 12, 2016, pp. 1-6.*
Wahlestedt et al. PNAS 2000, 97:5633-5638.*
Frey, N. et al. "Hypertrophy of the heart: a new therapeutic target?", Circulation, 2004, 109(13), p. 1580-9.
Hu, et al. "An Agomir of miR-144-3p Accelerates Plaque Formation through Impairing Reverse Cholesterol Transport and Promoting Pro-Inflammatory Cytokine Production", *PLoS ONE*, Apr. 14, 2014, 9(4): e94997, 12 pages.
James, J., et al., "Forced expression of alpha-myosin heavy chain in the rabbit ventricle results in cardioprotection under cardiomyopathic conditions", Circulation, 2005, 111(18), p. 2339-46.
Jiang, J., et al. "Allele-specific silencing of mutant Myh6 transcripts in mice suppresses hypertrophic cardiomyopathy", Science, 2013, 342(6154), p. 111-4.
Krenz, M. and J. Robbins, "Impact of beta-myosin heavy chain expression on cardiac function during stress", J Am Coll Cardiol, 2004, 44(12), p. 2390-7.
Lowes, B.D. et al. "Changes in gene expression in the intact human heart. Downregulation of alpha-myosin heavy chain in hypertrophied, failing ventricular myocardium", J Clin Invest, 1997, 100(9), p. 2315-24.
Montgomery, R.L., et al., Therapeutic inhibition of miR-208a improves cardiac function and survival during heart failure. Circulation, 2011, 124(14), p. 1537-47.
NCBI Reference Sequence: NM_020884.4. *Homo sapiens* myosin, heavy chain 7B, cardiac muscle, beta (MYH7B), mRNA (Jun. 21, 2014) (Retrieved from the Internet Oct. 24, 2015: <http:1/www.ncbi .nlm.nih.gov/nuccore/599045670?sat= 18&satkey= 18602859>]; in entirety.
Teekakirikul, P., et al. "Hypertrophic cardiomyopathy: translating cellular cross talk into therapeutics", J Cell Biol, 2012, 199(3), p. 417-21.

(Continued)

*Primary Examiner* — Brian Whiteman
(74) *Attorney, Agent, or Firm* — Cooley LLP

(57) ABSTRACT

The present invention provides nucleic acid inhibitors of MYH7B and compositions thereof. The present invention also provides methods of treating or preventing a cardiac disorder such as cardiac hypertrophy, myocardial infarction, or heart failure in a subject by administering to the subject an inhibitor of MYH7B. The present invention further provides methods of modulating the activity or expression of β-MHC in cardiac cells of a subject by administering to the subject an inhibitor of MYH7B.

29 Claims, 12 Drawing Sheets

(56) References Cited

OTHER PUBLICATIONS

Van Rooij, E., et al., "Control of stress-dependent cardiac growth and gene expression by a microRNA", Science, 2007, 316(5824), p. 575-9.

Van Rooij, E., et al., "A family of microRNAs encoded by myosin genes governs myosin expression and muscle performance", Dev Cell, 2009, 17(5), p. 662-73.

International Search Report and Written Opinion issued for PCT/US2015/043571 mailed on Jan. 27, 2016.

\* cited by examiner

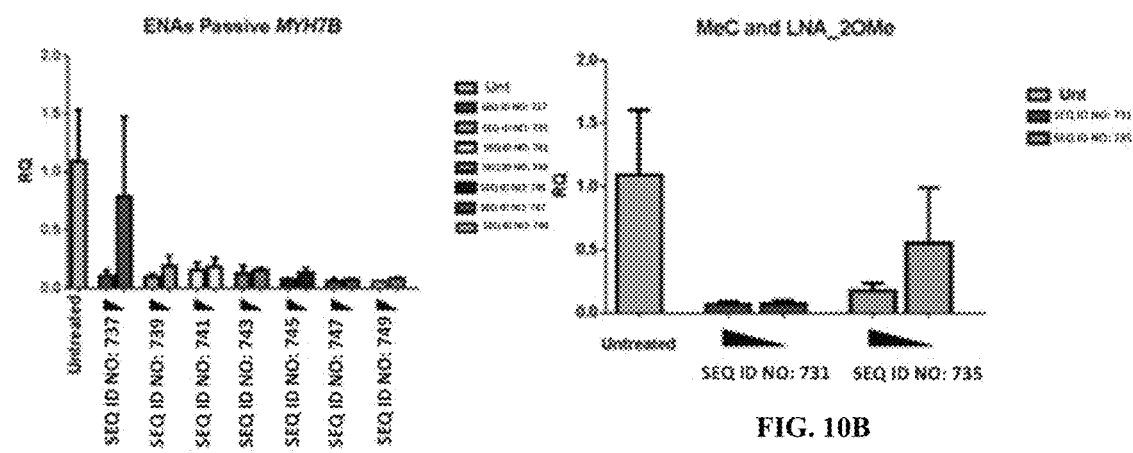
FIG. 10A
FIG. 10B
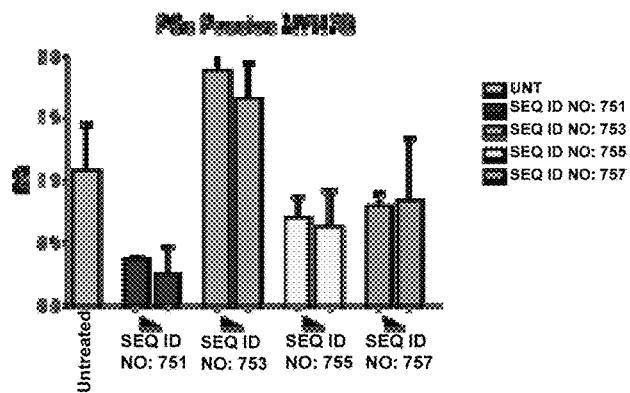
FIG. 10C

INHIBITORS OF MYH7B AND USES THEREOF

CROSS REFERENCE TO RELATED APPLICATIONS

The present application claims the benefit of priority to U.S. Provisional Application No. 62/033,018, filed on Aug. 4, 2014, the contents of which are hereby incorporated by reference in their entirety.

FIELD OF THE INVENTION

The present invention relates to inhibitors of a myosin heavy chain gene, MYH7B, and compositions thereof. The invention also provides methods for treating or preventing cardiac disorders such as cardiac hypertrophy, myocardial infarction, and heart failure by administering inhibitors of MYH7B. In particular, the invention discloses nucleic acid inhibitors of MYH7B and compositions thereof, and methods for treating or preventing cardiac disorders by inhibiting the expression or activity of MYH7B in a subject in need thereof.

BACKGROUND

Heart disease is the leading cause of a death in the United States and presents a major health risk for millions of people across the world. The cost to diagnose, treat and support patients suffering from various types of heart disease, including hypertrophic cardiomyopathy, myocardial infarction, and heart failure, is very high and puts a serious burden on the healthcare system.

Hypertrophic cardiomyopathy (HCM) is of particular concern because it is a significant cause of sudden unexpected cardiac death and is frequently asymptomatic prior to onset of cardiac arrest. HCM is characterized by a thickening of myocardial cells, which can affect ventricular function and give rise to cardiac arrhythmias. HCM is a primary genetic disease of the heart, resulting from a dominant mutation in a number of sarcomeric genes, of which 8 have been extensively studied (Teekakirikul et al., "Hypertrophic cardiomyopathy: translating cellular cross talk into therapeutics," J. Cell. Biol., 2012, 199(3), 417-421). Of these dominant mutations in HCM, roughly 40% are missense mutations in the β-myosin gene, MYH7. Genetic and pharmacologic studies have shown reductions in expression of this dominant allele, even to a small degree, can have robust phenotypic effects (Jiang et al., "Allele-specific silencing of mutant MYH6 transcripts in mice suppresses hypertrophic cardiomyopathy," Science, 2013, 342(6154), 111-114).

Myosin is the major contractile protein of cardiac and skeletal muscle cells. Cardiac muscle contraction depends on the expression and relative ratios of two myosin heavy chain (MHC) proteins, α-MHC (MYH6) and β-MHC (MYH7). In rodents, α-MHC, a fast-twitching MHC, is the predominant myosin isoform in the adult heart, whereas β-MHC, a slow-twitching MHC, is predominantly expressed in the developing heart and is downregulated after birth (Morkin, E., "Control of cardiac myosin heavy chain gene expression," Microsc. Res. Tech., 2000, 50, 522-531). In contrast, in human heart, the β-MHC isoform is heavily expressed and the α-MHC isoform accounts for less than 8% of total ventricular MHC (Miyata et al., "Myosin heavy chain isoform expression in the failing and nonfailing human heart," Circ. Res., 2000, 86(4):386-90). Irrespective of the differences in the expression of alpha- and beta-myosins in various species, studies indicate that expression of beta-myosin is upregulated in cardiac disorders in these species including humans, rats, and rabbits. For example, in failing adult mouse hearts, a shift from the normally predominant alpha-MHC toward beta-MHC is often observed (Harada et al., Circulation, 1999, 100, 2093-2099). Similarly, in rats, congestive heart failure was associated with increased expression of beta-myosin and decreased expression of alpha-MHC. Consistent with rodent studies, beta-myosin expression was upregulated and alpha-myosin expression was significantly down-regulated in failing human hearts (Miyata et al., "Myosin heavy chain isoform expression in the failing and nonfailing human heart", Circ Res. 2000 Mar. 3; 86(4):386-90). These studies show that although the expression of alpha- and beta-myosins is species-dependent, downregulating the expression of beta-myosin is likely to play a cardioprotective role in various species. For example, blunting the increase in β-MHC expression and increasing α-MHC expression has shown to be cardioprotective in rabbits (James et al., "Forced expression of alpha-myosin heavy chain in the rabbit ventricle results in cardioprotection under cardiomyopathic conditions," Circulation, 2005, 111(18), 2339-2346).

The genes encoding α-MHC (MYH6), β-MHC (MYH7), and a related myosin, MYH7B, also encode a family of intronic miRNAs, miR-208a, miR-208b, and miR-499, respectively. These three miRs share sequence homology and are called the "MyomiRs" (van Rooji et al., "A family of microRNAs encoded by myosin genes governs myosin expression and muscle performance," Dev. Cell, 2009, 17, 662-673). MyomiRs have been shown to control pathological cardiac remodeling, muscle myosin content, myofiber identity, and muscle performance (Liu and Olson, "MicroRNA regulatory networks in cardiovascular development," Dev. Cell, 2010, 510-525).

Although the role of α-MHC, β-MHC, and myomiRs (miR-208a, miR-208b, and miR-499) in cardiac and muscle development have been extensively studied, the role of the third myosin, MYH7B, is largely unknown. The MYH7B gene is expressed in skeletal muscle, heart, and in a subset of cells in the brain where it regulates synapse structure and function in the brain (Yeung et al., "Myh7b/miR-499 gene expression is transcriptionally regulated by MRFs and Eos," Nucleic Acids Res., 2012, 40(15):7303-18). A recent report suggests that MYH7b protein is detected in a minor fibre population in extraocular muscles, corresponding to slow-tonic fibres, and in bag fibres of muscle spindles (Rossi et al., "Two novel/ancient myosins in mammalian skeletal muscles: MYH14/7b and MYH15 are expressed in extraocular muscles and muscle spindles", J Physiol., Jan. 15, 2010; 588(Pt 2):353-64). However, in human heart, MYH7B gene is considered to undergo non-productive splicing, and result in a RNA that may not encode a functional MYH7B protein (Bell et al., "Uncoupling of expression of an intronic microRNA and its myosin host gene by exon skipping," Mol. Cell. Biol., 30, 1937-1945). Interestingly, the non-productive splicing of MYH7B mRNA in heart cells was not associated with altered expression of intronic miR-499. Thus, until the present invention, MYH7B was considered to be a non-functioning carrier of miR-499 in cardiac cells (Gerald Dorn, II, "MicroRNAs: redefining mechanisms in cardiac disease," J. Cardiovasc. Pharmacol., 2010, 56(6), 589-595). Moreover, unlike miR-499, MYH7B is considered not to play an important role in cardiac and skeletal muscle biology.

SUMMARY OF THE INVENTION

The present invention is based, in part, on the surprising discovery that MYH7B regulates the expression of β-MHC in cardiac cells and thus regulates cardiac contractility and stress-induced cardiac remodeling. Specifically, the inhibition of MYH7B results in the down-regulation of β-MHC mRNA and protein in cardiac cells. Accordingly, in one embodiment, the present invention provides inhibitors of MYH7B, compositions thereof, and methods for modulating the expression and/or activity of β-MHC in a subject in need thereof comprising administering to the subject the inhibitor of MYH7B. In one embodiment, administration of an inhibitor of MYH7B to the subject downregulates the expression or activity of MYH7B in cardiac cells of the subject following administration. In an embodiment, administration of an inhibitor of MYH7B to the subject downregulates the expression or activity of β-MHC (MYH7) in cardiac cells of the subject following administration. In another embodiment, administration of an inhibitor of MYH7B to the subject upregulates the expression or activity of α-MHC (MYH6) in cardiac cells of the subject following administration. In yet another embodiment, administration of an inhibitor of MYH7B to the subject induces a "switch" in the myosins whereby the expression or activity of β-MHC is downregulated and the expression or activity of α-MHC is upregulated in the subject following administration. In one embodiment, administration of an inhibitor of MYH7B to the subject does not change the expression or activity of miR-208a, miR-208b, or miR-499 in cardiac cells of the subject.

In another embodiment, the present invention provides compositions and methods for treating or preventing cardiac disorders such as pathologic cardiac hypertrophy, myocardial infarction, heart failure, or hypertrophic cardiomyopathy in a subject in need thereof comprising administering an inhibitor of MYH7B to the subject. In one embodiment, the subject having a cardiac disorder has increased levels of β-MHC in cardiac cells compared to a healthy subject. In another embodiment, the subject having a cardiac disorder has an altered ratio of β-MHC/α-MHC in cardiac cells compared to a healthy subject. In one embodiment, the administration of an inhibitor of MYH7B to a subject having a cardiac disorder inhibits the expression or activity of MYH7B and/or the expression or activity of MYH7 in cardiac cells of the subject following administration. In another embodiment, the administration of a MYH7B inhibitor to a subject having a cardiac disorder restores the β-MHC/α-MHC ratio in cardiac cells of the subject fully or partially to normal levels following administration. In one embodiment, the cardiac disorder is cardiac hypertrophy, myocardial infarction, heart failure, or hypertrophic cardiomyopathy.

In one embodiment, an inhibitor of MYH7B is a nucleic acid inhibitor selected from an antisense oligonucleotide, an aptamer, a ribozyme, a small interfering RNA (siRNA), or a small hairpin RNA (shRNA). In another embodiment, an inhibitor of MYH7B is an antibody or a binding fragment thereof that specifically binds to MYH7B protein. In a particular embodiment, an inhibitor of MYH7B is an antisense oligonucleotide that comprises a sequence that is at least partially complementary to a MYH7B coding sequence. The antisense oligonucleotides used in the compositions and methods of the invention may have a length of from about 6 to about 22 nucleotides. In some embodiments, the antisense oligonucleotides comprise one or more chemical modifications, such as sugar, backbone, and/or base modifications.

In one embodiment, an antisense oligonucleotide inhibitor of MYH7B has a length of 8 to 18 nucleotides, and wherein the sequence of the antisense oligonucleotide is substantially complementary to the sequence of SEQ ID NO: 6.

In some embodiments, an antisense oligonucleotide inhibitor of MYH7B has a length of 8-18 nucleotides and the sequence of the antisense oligonucleotide is substantially complementary to the sequence of SEQ ID NO: 6 from nucleotides 4300-4335.

In some other embodiments, the antisense oligonucleotide inhibitor of MYH7B has a length of 12-18 nucleotides and the sequence of the antisense oligonucleotide is substantially complementary to the sequence of SEQ ID NO: 6 from nucleotides 4300-4317.

In still other embodiments, the antisense oligonucleotide inhibitor of MYH7B has a length of 12-18 nucleotides and the sequence of the antisense oligonucleotide is substantially complementary to the sequence of SEQ ID NO: 6 from nucleotides 4316-4333.

In one embodiment, the antisense oligonucleotide inhibitor of MYH7B has a length of 14 nucleotides and the sequence of the antisense oligonucleotide is substantially complementary to the sequence of SEQ ID NO: 6 from nucleotides 4302-4315.

In another embodiment, the antisense oligonucleotide inhibitor of MYH7B has a length of 14 nucleotides and the sequence of the antisense oligonucleotide is substantially complementary to the sequence of SEQ ID NO: 6 from nucleotides 4318-4331.

In some embodiments, antisense oligonucleotide inhibitors of the invention contain at least one modified nucleotide. The modified nucleotide may include a sugar, base, and/or a backbone modification.

In one embodiment, the modified nucleotide is a locked nucleotide. In some embodiments, the antisense oligonucleotide inhibitor contains one to six locked nucleotides. In some embodiments, at least the first three nucleotides at the 5' end of the antisense oligonucleotide inhibitor are locked nucleotides. In another embodiment, at least the first three nucleotides at the 3' end of the antisense oligonucleotide inhibitor are locked nucleotides.

In some embodiments, at least the first three nucleotides at the 5' end of the antisense oligonucleotide inhibitor are locked or non-locked ribonucleotides. In some embodiments, the at least first three nucleotides at the 3' end of the antisense oligonucleotide inhibitor are locked or non-locked ribonucleotides.

In one embodiment, the antisense oligonucleotide inhibitor contains at least one deoxyribonucleotide. In other embodiments, the antisense oligonucleotide inhibitor contains two to eight deoxyribonucleotides.

In various embodiments, the antisense oligonucleotide inhibitor of MYH7B may include a sugar modification selected from the group consisting of 2'-O, 4'-C methylene bridge, 2'-O, 4'-C ethylene bridge, 2'-CH$_2$—NH—CH$_2$-4' bridge, 2'-deoxy, 2'-O-alkyl, and 2'-halo modifications.

In various embodiments, the antisense oligonucleotide inhibitor of MYH7B may include a backbone modification. In one embodiment, the antisense oligonucleotide inhibitor contains at least one phosphorothioate linkage. In another embodiment, the antisense oligonucleotide inhibitor contains two or more phosphorothioate linkages. In still other embodiments, the antisense oligonucleotide is fully phosphorothioate linked.

In one embodiment, the antisense oligonucleotide inhibitor of MYH7B further comprises a peptide or a sugar moiety connected through a linker. The linker could be a 3'thiol-modified-C$_3$-disulfide linker, (C$_6$)$_2$ disulfide linker, or 1-3 phosphodiester linkages.

In certain embodiments, the antisense oligonucleotide inhibitor of MYH7B comprises a sequence selected from Tables 1-5.

In one embodiment, the antisense oligonucleotide inhibitor of MYH7B comprises the sequence of 5'-lTslTslGsdAsdTsdCsdTsdTsdGsdGsdCslCslTslC-3' (SEQ ID NO: 146) or 5'-lCslTslGsdCsdAsdGsdCsdTsdCsdCsdTslCslCslA-3' (SEQ ID NO: 148).

The invention also provides pharmaceutical compositions comprising an inhibitor of MYH7B and a pharmaceutically acceptable excipient. In one embodiment, the inhibitor of MYH7B is an antisense oligonucleotide. In one aspect, the pharmaceutical composition further comprises a second therapeutic agent, wherein the second therapeutic agent is an antisense oligonucleotide inhibitor of miR-208a, miR-208b, miR-499, miR-15a, miR-15b, miR-16, miR-195, or a mixture thereof.

The invention further provides a method for treating or preventing pathologic cardiac hypertrophy, myocardial infarction, or heart failure in a subject in need thereof, comprising administering to the subject an antisense oligonucleotide inhibitor of MYH7B. In one embodiment, the pathologic cardiac hypertrophy is hypertrophic cardiomyopathy. In some embodiments, the methods according to the invention may comprise administering a second cardiac therapeutic agent such as an antisense oligonucleotide inhibitor of miR-208a, miR-208b, miR-499, miR-15a, miR-15b, miR-16, miR-195, or combinations thereof.

In some embodiments, the invention provides a method of treating a subject who is at risk for pathologic cardiac hypertrophy. In one embodiment, the subject at risk for pathologic cardiac hypertrophy has a mutation in a beta myosin heavy chain gene.

In one aspect, administration of the antisense oligonucleotide inhibitor of MYH7B reduces the expression or activity of MYH7B in cardiac cells of the subject following administration. In another aspect, administration of the antisense oligonucleotide inhibitor of MYH7B reduces the expression of beta myosin heavy chain in cardiac cells of the subject following administration. In yet another aspect, administration of the antisense oligonucleotide inhibitor of MYH7B does not significantly alter the expression of miR-499, miR-208a, and/or miR-208b in cardiac cells of the subject following administration.

In some embodiments, the invention provides a method for treating or preventing pathologic cardiac hypertrophy, myocardial infarction, or heart failure in a subject in need thereof, comprising administering to the subject an inhibitor of MYH7B. In various embodiments, the inhibitor of MYH7B is a nucleic acid inhibitor selected from an antisense oligonucleotide, an aptamer, a ribozyme, a small interfering RNA, or a small hairpin RNA.

In one embodiment, the nucleic acid inhibitor of MYH7B is a small interfering RNA or a small hairpin RNA comprising a double-stranded region of about 10 to about 30 nucleotides, said double-stranded region comprising (i) a first RNA strand having a sequence that is at least 70% identical to a sequence of the human Myh7b gene and (ii) a second RNA strand that is partially, substantially, or fully complementary to the first RNA strand. In one aspect, the first RNA strand of the siRNA or shRNA has a sequence that is at least 70% identical to a sequence of 5'-GAGGCCAAGATCAA-3' (SEQ ID NO: 4). In another aspect, the first RNA strand of the siRNA or shRNA has a sequence that is at least 70% identical to a sequence of 5'-TGGAGGAGCTGCAG-3' (SEQ ID NO: 5).

BRIEF DESCRIPTION OF THE DRAWINGS

FIG. 10A shows levels of MYH7B mRNA in human iPS cardiomyocytes 48 hrs after passive administration of ENA-modified ASOs based on the compound comprising the sequence of SEQ ID NO: 146. FIG. 10B shows levels of MYH7B mRNA in human iPS cardiomyocytes 48 hrs after passive administration of 5-methyl cytidine and 2'-O-methyl modified ASOs of the compound comprising the sequence of SEQ ID NO: 146. FIG. 10C shows levels of MYH7B mRNA in human iPS cardiomyocytes 48 hrs after passive administration of backbone-modified ASOs of the compound comprising the sequence of SEQ ID NO: 146.

DETAILED DESCRIPTION OF THE INVENTION

Figure 1A:
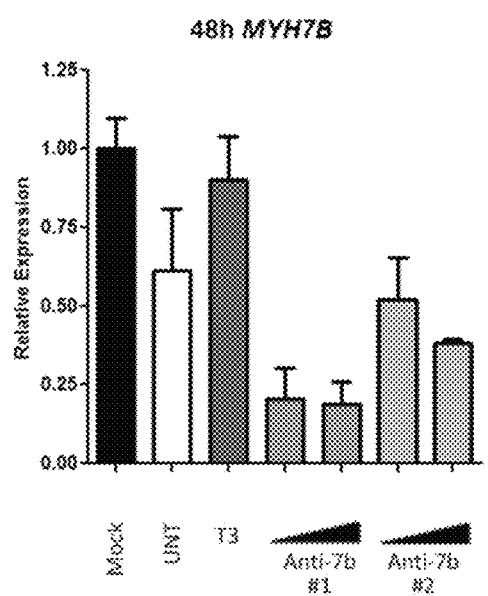
FIG. 1A shows levels of MYH7B mRNA in human iPS cardiomyocytes 48 hours after transfection with antisense oligonucleotides to MYH7B.

The inventors have found that MYH7B, which was considered until now to act merely as a non-functional carrier of miR-499, plays an important role in regulating the expression of β-MHC in cardiac cells. Particularly, the inventors have found that the inhibition of MYH7B down-regulates the expression of β-MHC mRNA and protein in cardiac cells. Thus, the present invention provides MYH7B as a new target for therapeutic intervention for cardiac disorders, particularly cardiac muscle disorders.

The present invention provides agents that inhibit the expression or activity of MYH7B. In various embodiments, the agent that inhibits MYH7B is a nucleic acid inhibitor targeted to MYH7B gene, mRNA, or pre-mRNA or an antibody or a binding fragment thereof targeted to MYH7B protein. In certain embodiments, a nucleic acid inhibitor of MYH7B is selected from an antisense oligonucleotide, an aptamer, a ribozyme, a small interfering RNA, or a small hairpin RNA.

In one embodiment, an inhibitor of MYH7B is an antisense oligonucleotide ("ASO"). In the context of the present invention, the term "antisense oligonucleotide" or "ASO" is used broadly and encompasses an oligomer comprising ribonucleotides, deoxyribonucleotides, modified ribonucleotides, modified deoxyribonucleotides or a combination thereof that inhibits the information transfer from gene to protein. The term "antisense oligonucleotide" or "ASO" as used herein also includes oligomers comprising ribonucleotides, deoxyribonucleotides, modified ribonucleotides, modified deoxyribonucleotides or a combination thereof that facilitate transcriptional arrest; disruption of mRNA synthesis from pre-mRNA at various stages including capping, splicing, transport from nucleus to cytoplasm; degradation of mRNA such as that mediated by gapmer ASOs or other RNAse H-inducing ASOs; translational arrest where the ASO binds to target mRNA and makes it unavailable for translation; or steric blocking of target mRNA by hybridizing to it. The term "antisense oligonucleotide" as used herein also includes antisense oligonucleotide conjugates that comprise oligomers containing natural and/or modified nucleotides conjugated to or connected to a peptide or a sugar through a linker. The peptide or the sugar moiety and the linkers that can be used to prepare antisense oligonucleotide conjugates are described below in more detail.

In various embodiments, antisense oligonucleotides useful for inhibiting the activity of MYH7B are about 5 to about 25 nucleotides in length, about 6 to about 22 nucleotides in length, about 10 to about 30 nucleotides in length, about 12 to about 20 nucleotides in length, or about 20 to about 25 nucleotides in length. In certain embodiments, antisense oligonucleotides targeting MYH7B are about 8 to about 18 nucleotides in length, in other embodiments about 12 to about 18 nucleotides in length, and in still other embodiments about 12 to about 16 nucleotides in length. In some embodiments, antisense oligonucleotides targeting MYH7B are about 8, 9, 10, 11, 12, 13, 14, 15, 16, 17, 18, 19, 20, 21, 22, 23, 24, or 25 nucleotides in length.

In some embodiments, antisense oligonucleotide inhibitors directed to MYH7B are about 50 to about 150 nucleotides in length, about 60 to about 140 nucleotides in length, about 70 to about 130 nucleotides in length, about 80 to about 120 nucleotides in length, about 90 to about 110 nucleotides in length, or about 100 to about 120 nucleotides in length. In one embodiment, antisense oligonucleotide inhibitors are about 100 to about 120 nucleotides in length. In certain embodiments, antisense oligonucleotide inhibitors targeting MYH7B are about 80, 90, 100, 110, or 120 nucleotides in length.

Antisense oligonucleotides targeting MYH7B comprise a sequence that is at least partially or substantially complementary to a MYH7B sequence (DNA, mRNA, or pre-mRNA) to hybridize to MYH7B under physiological conditions and inhibit the expression or activity of MYH7B in the cells of a subject. For instance, in some embodiments, antisense oligonucleotides comprise a sequence that is at least partially complementary to a MYH7B gene, mRNA or pre-mRNA sequence, e.g. at least about 75%, 80%, 85%, 90%, 95%, 96%, 97%, 98%, or 99% complementary to a MYH7B gene, mRNA or pre-mRNA sequence. In some embodiments, the antisense oligonucleotide can be substantially complementary to a MYH7B gene, mRNA or pre-mRNA sequence, that is at least about 90%, 95%, 96%, 97%, 98%, or 99% complementary to a target polynucleotide sequence. In one embodiment, the antisense oligonucleotide comprises a sequence that is 100% or completely complementary to a MYH7B gene, mRNA or pre-mRNA sequence. In certain embodiments, the antisense oligonucleotide targeting MYH7B comprises a sequence that is at least partially, substantially, or completely complementary to the sequence of the human MYH7B gene. In some embodiments, the antisense oligonucleotide targeting MYH7B comprises a sequence that is at least partially, substantially, or completely complementary to the coding sequence of the human MYH7B gene (Genebank Accession No. NM_020884.4; SEQ ID NO: 6).

```
Human MYH7B coding sequence (SEQ ID NO: 6):
   1   taggcttaaa gagcaggcgg ggcagagacc cataccttttg gcgctgagtc gaggccagga 61   aggggcggtc gatgagaggg cggccttagc attaggagtg cgtcggctgc accctggcgg 121   atgaccttg  ggaaggaggg gaggggacca tcggggtcgg cggggagcta cgggttcccc 181   tcttccaaga cgggtgccaa gtgatgagta tcaggtgtct atggtgagat ttggggagga 241   tcccagacct taacagccct ttggttgaaa cctctcacaa tgtggcagag atggggtttt 301   gatgtgttgc ccaggctggt cttgaactcc tgagcttaag tgatgtgtcc gcctgggcct 361   cccaaagtgc tggaattaca gacatgagtg gcaataaaag gggtagcaga gcttcctgcc
```

-continued

```
 421 ctcaccgtgg tgccgagtgc ctgctgcctt gggccgcctt gaacctccag ggtttccagc
 481 tcctcctcct tcaccccagt gccactgcca tgatggatgt gagtgaactt ggggagtctg
 541 cccgctacct ccgccagggc taccaggaga tgacgaaggt gcacactatc ccatgggacg
 601 ggaagaagcg agtctgggtg cctgatgaac aggacgccta cgtggaggcc gaggtcaagt
 661 cggaggctac cggggggcaga gtcaccgtgg agaccaaaga ccagaaggtg ctgatggtgc
 721 gtgaagccga gctgcagccc atgaacccgc tcgcttcga cttactggag acatggcca
 781 tgatgacgca cctgaacgag gcctctgtgc tgcacaacct cgccagcgc tatgcccgct
 841 ggatgatcta tacctactca ggcctcttct gtgtcaccat caacccctac aaatggctcc
 901 cagtctatac ggcctccgta gtggctgctt acaagggaaa gcgccgctca gattccccgc
 961 cccatatata tgcggtggcg acaacgcct acaacgacat gctgcgcaac cgagacaacc
1021 agtccatgct gatcaccgga gagtcggggg ccggtaagac ggttaacacc aagcgggtca
1081 ttcagtactt tgccatcgtc gctgccctgg agacgggcc gggcaagaag gcccaatttc
1141 tggcaacaaa gacggggggc acccttgagg atcaaatcat cgaggccaac cctgccatgg
1201 aggcctttgg caacgccaag accctgagga tgataactc ctcccgcttt gcaagttca
1261 tccgcattca ctttggtccc tctgggaagc tggcatccgc ggatattgac agctatctcc
1321 tggagaagtc gcgggtgatc ttccagttgc ctggtgagcg cagctaccat gtctactacc
1381 agatcctctc agggaggaag ccagagctgc aggacatgct gcttctgtct atgaacccct
1441 atgactacca cttctgcagc cagggcgtca tcaccgtgga caacatgaat gatggggagg
1501 agctcatcgc caccgaccat gccatggaca tcctaggctt cagcgtggat gagaaatgtg
1561 cctgctataa gatcgtgggc gccctcctgc actttggcaa catgaagttc aagcagaagc
1621 agcgggagga gcaggcggag gccgatggca ctgagagtgc tgacaaggct gcctacctga
1681 tgggggtcag cagtggggac ctcctcaaag ccttttgca ccccgggtg cgtgtaggga
1741 acgagtacgt gaccaagggc cagagtgtgg agcaggtggt gtttgctgtg ggggctctgg
1801 ccaaggccac ctatgaccgg ctgttcaggt ggctggtgtc tcggatcaac cagacccctgg
1861 acacaaagct gccccggcag ttcttcatcg gggttctgga catcgctggg tttgagatct
1921 ttgagttcaa cagcttcgaa cagctgtgca tcaacttcac caatgagaaa ttgcagcagt
1981 tcttcaacca gcacatgttt gtgctggagc aggaggagta caagcgggag gcatcgact
2041 gggtcttcat cgacttcggc cttgacctgc agccttgcat cgacctcatc gagaagccac
2101 tgggcatcct gtccatcctg gaggaggaat gcatgttccc caaggcctca gacgccagct
2161 tccgggccaa gctctacgac aaccacgcgg ggaagtcacc caatttccag cagcctcggc
2221 ctgacaagaa gcgcaagtac caggcccact tcgaggtggt ccactacgca ggcgtggtgc
2281 cttacagcat tgtgggctgg ctggagaaaa acaaggatcc cctgaatgag accgtggtcc
2341 ccatcttcca gaagtcacag aataggctcc tggcgactct ctatgagaat tatgcgggct
2401 cctgctccac tgagcccccc aagtctgggg tgaaagagaa gcgtaagaag gcagcatcgt
2461 tccagacggt gtcccagctg cacaaggaga acctcaacaa gctgatgacc aacctgcggg
2521 ccacacagcc ccacttcgtc cgctgcattg tccccaacga gaacaaaacc caggggtca
2581 tggatgcctt cttggtgcta caccagctgc gctgcaatgg ggtcctggag gggatccgga
2641 tctgccgcca agggttcccc aacaggttgc tctacaccga cttccggcag cggtaccgta
2701 tcctgaaccc cagtgccatc ccggatgaca ccttcatgga cagcaggaag gccacagaga
2761 aactgctggg ctcgctggac ttggatcaca cccagtacca gtttggccac accaaggtgt
```

-continued

```
2821  tcttcaaggc tgggcttcta ggcgtcctgg aagagctccg tgaccagcgc ctggccaagg
2881  tgctgacgct gctgcaggcg cggagccgtg ccgcctcat gcgccttgag taccagcgcc
2941  tgctgggagg cagggatgcg ctgttcacca tccagtggaa catccgtgcc ttcaatgccg
3001  tcaagaactg gtcatggatg aagctctttt tcaagatgaa gccgctgctg cgctcggcgc
3061  aggctgagga ggagctggcg gccctgcggg cagagctgcg ggggttgcga ggggcgctgg
3121  ctgcggccga ggccaagcgc caggaactgg aggagacgca cgtcagcatc acccaggaga
3181  agaatgacct ggccctgcag ctgcaggctg agcaggacaa cctggcagat gccgaggagc
3241  gctgccactt gctgatcaag tccaaggtgc agctggaggg aaggtgaag gagctgagtg
3301  agcggctgga ggatgaggag gaggtgaacg ctgacctggc cgcccgccgg cgcaagctgg
3361  aggacgagtg cacggagctc aagaaggaca ttgatgacct ggagctgaca ctggccaaag
3421  ctgagaagga gaagcaagcc actgagaaca aggtgaagaa cctgacggaa gagatggctg
3481  cgctggacga gtcagtggcc cggctgacca aggagaagaa ggcgttgcag gaggcccacc
3541  aacaggccct gggtgacctg caggccgagg aggaccgtgt gagcgcgctg accaaggcca
3601  agctccggct ggagcaacag gtggaggacc tggaatgctc cctggagcag gagaagaagc
3661  tgcgcatgga cacggagcgg gccaagcgca agctggaggg tgacctgaag ctgacgcagg
3721  agtcggtggc tgatgctgct caagacaagc agcagctgga ggagaagctc aagaagaagg
3781  actccgagct gagccagctg agcctgcggg tggaagacga gcagctcttg ggggcccaga
3841  tgcagaagaa gatcaaggag ctgcaggctc gggcggagga gctggaagag gagctggagg
3901  cagagcgggc agcccgggcc cgcgtggaga agcagcgtgc gagggcggcg cgggagctgg
3961  aggagctgag cgagcggctg gaggaggcag gcggcgcatc cgcggggcag cgcgagggct
4021  gccgcaagcg ggaggcggag ctggggaggc tgcggcggga gctggaggag gcggcgctgc
4081  ggcacgaggc cacagtggcg gcactgcggc gcaagcaggc ggagggcgcg gcggagctgg
4141  gggagcaggt ggacagcctg cagcgggtgc ggcagaagct ggagaaggag aagagtgagc
4201  tgcgcatgga ggtggacgac ctggctgcca acgtggagac tctgacccgc gccaaggcca
4261  gtgcagagaa gctgtgccgg acctatgagg atcagctaag cgaggccaag atcaaggtgg
4321  aggagctgca gcggcagctg cggacgcaa gcacgcagcg tgggcgacta cagacggaaa
4381  gcggggagct gagtcgcctg ctagaggaga aggagtgtct gatcagtcag ctgagccgtg
4441  gaaaggccct ggccgcccaa agcctggaag agttgcggcg ccagctagag gaggaaagca
4501  aggccaagag tgccctggcc cacgccgtgc aggctctgcg gcacgactgt gacctcctgc
4561  gggagcaaca cgaggaggag gctgaggccc aggctgagct gcagcggctg ctgtccaagg
4621  ccaatgccga ggtgggcag tggaggagca agtacgaagc agatgccatc cagaggaccg
4681  aggagctgga ggaggccaaa aaaaagctgg cactgcggct gcaggaggca gaggagggcg
4741  tggaggctgc caacgccaag tgctcatcgt tggagaaggc caagctgcgg ctacagacag
4801  agtcagagga tgtaaccctg gagctggagc gggcgacctc agcagctgct gcgctggaca
4861  agaagcagcg gcacttggaa cgggcactgg aggaacggcg gcggcaggag gaggagatgc
4921  agcgggagct ggaggcggca cagagggagt cccgtggcct gggcaccgag ctcttccggc
4981  tgcggcacgg ccacgaggag gcacttgaag ccctggagac gctcaagcgg gagaacaaga
5041  acctgcagga ggagatcagc gacctcacag accaggtgag tctcagtggg aagagcatcc
5101  aggaactgga gaaaaccaag aaggcgctgg aaggcgagaa gagtgagatc caggctgcac
5161  tggaggaggc agagggggcc ctggagctgg aggagaccaa gacgctgcgg atccagctgg
5221  agctctccca ggtcaaagca gaagtggacc ggaagctggc agagaaagac gaggagtgcg
```

```
-continued 5281  ctaacctgag gcgcaaccac cagcgagctg tggagtccct gcaggcctcc ctggatgcag 5341  agacacgggc ccgcaatgag gcgctgcggc tcaagaagaa gatggagggt gacctcaacg 5401  acctggagct gcagctgggc catgccaccc gtcaggccac agaggcccag gctgccacgc 5461  ggctgatgca ggcacagctc aaggaggagc aggcagggcg ggacgaggag cagcggctgg 5521  cagctgagct ccacgagcag gcgcaggctc tggagcgccg ggcctcgctg ctggctgcgg 5581  agctggagga gctgcgggct gccctggagc agggcgagcg cagccggcga ctggcagagc 5641  aggagctttt ggaggccacc gagcgcctca accttctgca ttcgcagaac acaggcctcc 5701  taaaccagaa gaagaagctg gaggcggact tggcccagct gagcggggag gtggaggagg 5761  ctgcacagga gaggcgggag gctgaggaga aggccaaaaa ggccatcact gatgcggcca 5821  tgatggccga ggagctgaag aaggagcagg acacaagtgc acacctggaa cggatgaaga 5881  agacgctgga gcagacggtg cgcgagctcc aggcccgcct tgaggaggca gaacaggccg 5941  ccctccgtgg cgggaagaag caggtgcaga agctggaggc caaggtacgg gagctggagg 6001  ctgagcttga tgcagagcag aagaagcacg ccgaggccct taagggcgtg cgcaagcatg 6061  agcgccgtgt caaggagctc gcataccagg ccgaggagga caggaagaac ctggctcgca 6121  tgcaggacct ggtggacaag ctgcagagca aggtcaagag ctacaagcgc cagtttgagg 6181  aggcggagca gcaggccaac accaacctgg ccaagtatcg caaggcccag cacgagctgg 6241  atgatgcgga ggagcgggca gacatggcgg aaacccaggc caacaagctg cgggcacgga 6301  cccgggacgc cctgggcccc aagcacaagg agtgacggcc tgaccccctg ggctctaaag 6361  aggaatgtct gctgttgcac atctggctga ggccacctgc cccgatcctg ccatctctgc 6421  atcgccccct gctgccttca gccttccctg ggccctgaat aaacaccaca gccagtttcc 6481  ttctcattct tttctttggg gttcaggagg aaaaacacag tcctagggac aaaagccagg 6541  tccacagcag tcatttttaa aataaagtta tttaatagtc tccaaaaaaa aaaaaaaaaa 6601  aa
```

It is understood that the sequence of the antisense oligonucleotide inhibitor is considered to be complementary to a MYH7B gene, mRNA or pre-mRNA sequence even if the antisense oligonucleotide sequence includes a modified nucleotide instead of a naturally-occurring nucleotide. For example, if a MYH7B gene, mRNA or pre-mRNA sequence comprises a guanosine nucleotide at a specific position, the antisense oligonucleotide inhibitor may comprise a modified cytidine nucleotide, such as a locked cytidine nucleotide or 2'-fluoro-cytidine, at the corresponding position.

In one embodiment, the invention provides an antisense oligonucleotide inhibitor of MYH7B, wherein said antisense oligonucleotide has a length of 8 to 18 nucleotides, and wherein the sequence of the antisense oligonucleotide is substantially complementary to the sequence of SEQ ID NO: 6.

In one embodiment, the antisense oligonucleotide inhibitor has a length of 8 to 18 nucleotides and comprises a sequence that is substantially complementary to the sequence of SEQ ID NO: 6 from nucleotides 4300-4335.

In certain embodiments, the antisense oligonucleotide inhibitor has a length of 12-18 nucleotides and comprises a sequence that is substantially complementary to the sequence of SEQ ID NO: 6 from nucleotides 4300-4317, 4300-4316, 4301-4316, 4301-4315, 4302-4317, 4302-4316, or 4302-4315. In one embodiment, the antisense oligonucleotide inhibitor has a length of 12-14 nucleotides and comprises a sequence that is substantially complementary to the sequence of SEQ ID NO: 6 from nucleotides 4302-4315. In some embodiments, the antisense oligonucleotide inhibitor has a length of 14 nucleotides and the sequence of the antisense oligonucleotide is substantially complementary to the sequence of SEQ ID NO: 6 from nucleotides 4302-4315. In one embodiment, the antisense oligonucleotide inhibitor comprises a sequence of 5'-lTslTslGsdAsdCsdTsdTsdGsdGsdCslCslTslC-3' (SEQ ID NO: 146), where l=locked nucleic acid modification, d=deoxynucleotide, and s=phosphorothioate linkage.

In certain embodiments, the antisense oligonucleotide inhibitor has a length of 12-18 nucleotides and comprises a sequence that is substantially complementary to the sequence of SEQ ID NO: 6 from nucleotides 4316-4333, 4316-4332, 4317-4332, 4317-4331, 4318-4333, 4318-4332, or 4318-4331. In one embodiment, the antisense oligonucleotide inhibitor has a length of 12-14 nucleotides and comprises a sequence that is substantially complementary to the sequence of SEQ ID NO: 6 from nucleotides 4318-4331. In some embodiments, the antisense oligonucleotide has a length of 14 nucleotides and the sequence of the antisense oligonucleotide is substantially complementary to the sequence of SEQ ID NO: 6 from nucleotides 4318-4331. In one embodiment, the antisense oligonucleotide inhibitor comprises a sequence of 5'-lCslTslGsdCsdAsdGsdCsdTsdCsdCsdTslCslCslA-3' (SEQ ID NO: 148).

In some embodiments, the antisense oligonucleotide inhibitor has a length of 8 to 18 nucleotides and comprises a sequence that is substantially complementary to the sequence of SEQ ID NO: 6 from nucleotides 1762-1783. In one embodiment, the antisense oligonucleotide inhibitor has a length of 12-18 nucleotides and comprises a sequence that is substantially complementary to the sequence of SEQ ID NO: 6 from nucleotides 1762-1779, 1763-1779, 1764-1781, 1765-1780, or 1766-1779. In one embodiment, the antisense oligonucleotide inhibitor has a length of 12-14 nucleotides and comprises a sequence that is substantially complementary to the sequence of SEQ ID NO: 6 from nucleotides 1764-1777 or 1766-1779. In one embodiment, the antisense oligonucleotide inhibitor comprises a sequence of 5'-lAslCslCsdTsdGsdCsdTsdCsdCsdAsdCslAslCslT-3' (SEQ ID NO: 62). In another embodiment, the antisense oligonucleotide inhibitor comprises a sequence of 5'-lCslCslAsdCsdCsdTsdGsdCsdTsdCsdCslAslCslA-3' (SEQ ID NO: 64).

In some embodiments, the antisense oligonucleotide inhibitor has a length of 8 to 18 nucleotides and comprises a sequence that is substantially complementary to the sequence of SEQ ID NO: 6 from nucleotides 511-538. In one embodiment, the antisense oligonucleotide inhibitor has a length of 12-18 nucleotides and comprises a sequence that is substantially complementary to the sequence of SEQ ID NO: 6 from nucleotides 511-532, 512-530, 513-526, 514-528, 514-527, 515-530, 515-529, or 515-528. In one embodiment, the antisense oligonucleotide inhibitor has a length of 12-14 nucleotides and comprises a sequence that is substantially complementary to the sequence of SEQ ID NO: 6 from nucleotides 513-526, 514-527, or 515-528. In yet another embodiment, the antisense oligonucleotide inhibitor has a length of 12-18 nucleotides and comprises a sequence that is substantially complementary to the sequence of SEQ ID NO: 6 from nucleotides 521-538, 522-538, 522-537, 523-538, 523-537, or 523-536. In yet another embodiment, the antisense oligonucleotide inhibitor has a length of 12-14 nucleotides and comprises a sequence that is substantially complementary to the sequence of SEQ ID NO: 6 from nucleotides 522-537 or 523-536. In one embodiment, the antisense oligonucleotide inhibitor comprises a sequence of 5'-lTslCslAsmdCsdTsmdCsdAsmdCsdAsdTsmdCslCslAslT-3', (SEQ ID NO: 184), where and =5-methylcytosine. In another embodiment, the antisense oligonucleotide inhibitor comprises a sequence of 5'-lTslTslCsdAsmdCsdTsmdCsdAsmdCsdAsdTslCslCslA-3' (SEQ ID NO: 186). In yet another embodiment, the antisense oligonucleotide inhibitor comprises a sequence of 5'-lGslTslTsmdCsdAsmdCsdTsmdCsdAsmdCsdAslTslCslC-3' (SEQ ID NO: 188). In still other embodiment, the antisense oligonucleotide inhibitor comprises a sequence of 5'-lCslTslCsmdCsmdCsmdCsdAsdAsdGsdTsdTslCslAslC-3' (SEQ ID NO: 204).

In certain embodiments, the antisense oligonucleotide inhibitor has a length of 8 to 18 nucleotides and comprises a sequence that is substantially complementary to the sequence of SEQ ID NO: 6 from nucleotides 1640-1701. In one embodiment, the antisense oligonucleotide inhibitor has a length of 12 to 18 nucleotides and comprises a sequence that is substantially complementary to the sequence of SEQ ID NO: 6 from nucleotides 1643-1660, 1648-1665, 1653-1670, or 1694-1711. In some embodiments, the antisense oligonucleotide inhibitor has a length of 12 to 14 nucleotides and comprises a sequence that is substantially complementary to the sequence of SEQ ID NO: 6 from nucleotides 1645-1658, 1650-1663, 1655-1668, or 1696-1709. In one embodiment, the antisense oligonucleotide inhibitor comprises a sequence of 5'-lAslCslTsmdCsdTsmdCsdAsdGsdTsdGsmdCslCslAslT-3' (SEQ ID NO: 230). In another embodiment, the antisense oligonucleotide inhibitor comprises a sequence of 5'-lTslCslAsdGsmdCsdAsmdCsdTsmdCsdTsmdCslAslGslT-3' (SEQ ID NO: 238). In yet another embodiment, the antisense oligonucleotide inhibitor comprises a sequence of 5'-lCslCslTsdTsdGsdTsmdCsdAsdGsmdCsdAslCslTslC-3' (SEQ ID NO: 244). In yet another embodiment, the antisense oligonucleotide inhibitor comprises a sequence of 5'-lTslTslTsdGsdAsdGsdGsdAsdGsdTslCslCslC-3' (SEQ ID NO: 272).

In some embodiments, the antisense oligonucleotide inhibitor has a length of 12 to 18 nucleotides and comprises a sequence that is substantially complementary to the sequence of SEQ ID NO: 6 from nucleotides 4280-4300. In one embodiment, the antisense oligonucleotide inhibitor has a length of 12 to 18 nucleotides and comprises a sequence that is substantially complementary to the sequence of SEQ ID NO: 6 from nucleotides 4280-4297, 4282-4295, 4283-4300 or 4283-4296. In one embodiment, the antisense oligonucleotide inhibitor comprises a sequence of 5'-lCslTslGsdAsdTsmdCsmdCsdTsmdCsdAsdTslAslGslG-3' (SEQ ID NO: 304). In another embodiment, the antisense oligonucleotide inhibitor comprises a sequence of 5'-lGslCslTsdGsdAsdTsmdCsmdCsdTsmdCsdAslTslAslG-3' (SEQ ID NO: 306).

In some embodiments, the antisense oligonucleotide inhibitor has a length of 12 to 18 nucleotides and comprises a sequence that is substantially complementary to the sequence of SEQ ID NO: 6 from nucleotides 688-705, 689-706, 690-707, or 690-703. In one embodiment, the antisense oligonucleotide inhibitor comprises a sequence of 5'-lTslGslGsdTsmdCsdTsdTsdTsdGsdGslTslCslTslC-3' (SEQ ID NO: 344). In other embodiments, the antisense oligonucleotide inhibitor has a length of 12 to 18 nucleotides and comprises a sequence that is substantially complementary to the sequence of SEQ ID NO: 6 from nucleotides 890-907, 892-909, or 892-905. In one embodiment, the antisense oligonucleotide inhibitor comprises a sequence of 5'-lGslAslCsdTsdGsdGsdGsdAsdGsmdCsmdCslAslTslT-3' (SEQ ID NO: 350).

In some embodiments, the antisense oligonucleotide inhibitor has a length of 12 to 18 nucleotides and comprises a sequence that is substantially complementary to the sequence of SEQ ID NO: 6 from nucleotides 1217-1234, 1218-1235, 1219-1236, or 1219-1232. In one embodiment, the antisense oligonucleotide inhibitor comprises a sequence of 5'-lAslTslTsmdCsmdCsdTsmdCsdAsdGsdGsdGslTslCslT-3' (SEQ ID NO: 362). In other embodiments, the antisense oligonucleotide inhibitor has a length of 12 to 18 nucleotides and comprises a sequence that is substantially complementary to the sequence of SEQ ID NO: 6 from nucleotides 1224-1241, 1225-1242, 1226-1243, or 1226-1239. In one embodiment, the antisense oligonucleotide inhibitor comprises a sequence of 5'-lAslGslTsdTsdAsdTsmdCsdAsdTsdTsmdCslCslTslC-3' (SEQ ID NO: 370).

In some embodiments, the antisense oligonucleotide inhibitor has a length of 12 to 18 nucleotides and comprises a sequence that is substantially complementary to the sequence of SEQ ID NO: 6 from nucleotides 1415-1441. In some embodiments, the antisense oligonucleotide inhibitor has a length of 12 to 18 nucleotides and comprises a sequence that is substantially complementary to the sequence of SEQ ID NO: 6 from nucleotides 1415-1432, 1416-1433, 1417-1434, or 1417-1430. In one embodiment, the antisense oligonucleotide inhibitor comprises a sequence of 5'-lAslGslAsmdCsdAsdGsdAsdAsdGsmdCsdAslGslCslA-3' (SEQ ID NO: 396). In some embodiments, the antisense oligonucleotide inhibitor has a length of 12 to 18 nucleotides and comprises a sequence that is substantially complementary to the sequence of SEQ ID NO: 6 from nucleotides 1422-1439, 1423-1440, 1424-1441, or 1424-1437. In one embodiment, the antisense oligonucleotide inhibitor comprises a sequence of 5'-lGslGslTsdTsmdCsdAsdTsdAsdGsdAsmdCslAslGslA-3' (SEQ ID NO: 410).

In some embodiments, the antisense oligonucleotide inhibitor has a length of 8 to 18 nucleotides and comprises a sequence that is substantially complementary to the sequence of SEQ ID NO: 6 from nucleotides 2348-2371. In one embodiment, the antisense oligonucleotide inhibitor has a length of 12-18 nucleotides and comprises a sequence that is substantially complementary to the sequence of SEQ ID NO: 6 from nucleotides 2348-2365, 2349-2364, 2348-2361, 2349-2366, 2350-2365, 2351-2366, 2352-2367, 2352-2365, 2353-2370, 2354-2369, or 2354-2368. In one embodiment, the antisense oligonucleotide inhibitor has a length of 12-14 nucleotides and comprises a sequence that is substantially complementary to the sequence of SEQ ID NO: 6 from nucleotides 2349-2362 or 2350-2363. In yet another embodiment, the antisense oligonucleotide inhibitor has a length of 12-14 nucleotides and comprises a sequence that is substantially complementary to the sequence of SEQ ID NO: 6 from nucleotides 2350-2363 or 2351-2364. In yet another embodiment, the antisense oligonucleotide inhibitor has a length of 12-14 nucleotides and comprises a sequence that is substantially complementary to the sequence of SEQ ID NO: 6 from nucleotides 2352-2365. In yet another embodiment, the antisense oligonucleotide inhibitor has a length of 12-14 nucleotides and comprises a sequence that is substantially complementary to the sequence of SEQ ID NO: 6 from nucleotides 2353-2366 or 2354-2367. In one embodiment, the antisense oligonucleotide inhibitor comprises a sequence of 5'-lAslTslTsmdCsdTsdGsdTsdGsdAsmdCsdTslTslCslT-3' (SEQ ID NO: 474). In another embodiment, the antisense oligonucleotide inhibitor comprises a sequence of 5'-lTslAslTsdTsmdCsdTsdGsdTsdGsdAsmdCslTslTslC-3' (SEQ ID NO: 476). In yet another embodiment, the antisense oligonucleotide inhibitor comprises a sequence of 5'-lCslTslAsdTsdTsmdCsdTsdGsdTsdGsdAslCslTslT-3' (SEQ ID NO: 478). In still other embodiment, the antisense oligonucleotide inhibitor comprises a sequence of 5'-lGslCslCsdTsdAsdTsdTsmdCsdTsdGsdT-slGslAslC-3' (SEQ ID NO: 482).

In some embodiments, the antisense oligonucleotide inhibitor has a length of 12 to 18 nucleotides and comprises a sequence that is substantially complementary to the sequence of SEQ ID NO: 6 from nucleotides 2442-2462. In certain embodiments, the antisense oligonucleotide inhibitor has a length of 12 to 14 nucleotides and comprises a sequence that is substantially complementary to the sequence of SEQ ID NO: 6 from nucleotides 2444-2457 or 2445-2458. In one embodiment, the antisense oligonucleotide inhibitor comprises a sequence of 5'-lAslTslGsmdCsdTsdGsmdCsdCsdTsdTsmdCslTslTslA-3' (SEQ ID NO: 508). In another embodiment, the antisense oligonucleotide inhibitor comprises a sequence of 5'-lGslAslTsdGsmdCsdTsdGsmdCsmdCsdTsdTslCslTslT-3' (SEQ ID NO: 510).

In some other embodiments, the antisense oligonucleotide inhibitor has a length of 12 to 18 nucleotides and comprises a sequence that is substantially complementary to the sequence of SEQ ID NO: 6 from nucleotides 4408-4432. In various embodiments, the antisense oligonucleotide inhibitor has a length of 12 to 18 nucleotides and comprises a sequence that is substantially complementary to the sequence of SEQ ID NO: 6 from nucleotides 4408-4425, 4409-4426, 4410-4425, 4411-4428, 4411-4427, 4412-4429, 4412-4428, or 4413-4430. In one embodiment, the antisense oligonucleotide inhibitor has a length of 12 to 16 nucleotides and comprises a sequence that is substantially complementary to the sequence of SEQ ID NO: 6 from nucleotides 4409-4424 or 4410-4425. In another embodiment, the antisense oligonucleotide inhibitor has a length of 12 to 16 nucleotides and comprises a sequence that is substantially complementary to the sequence of SEQ ID NO: 6 from nucleotides 4411-4426 or 4412-4427. In yet another embodiment, the antisense oligonucleotide inhibitor has a length of 12 to 16 nucleotides and comprises a sequence that is substantially complementary to the sequence of SEQ ID NO: 6 from nucleotides 4413-4428. In one embodiment, the antisense oligonucleotide inhibitor comprises a sequence of 5'-lAslTslCsdAsdGsdAsmdCsdAsmdCsdTsmdCslCslTslT-3' (SEQ ID NO: 570). In another embodiment, the antisense oligonucleotide inhibitor comprises a sequence of 5'-lTslGslAsdTsmdCsdAsdGsdAsmdCsdAsmdCslTslCslC-3' (SEQ ID NO: 572). In yet another embodiment, the antisense oligonucleotide inhibitor comprises a sequence of 5'-lCslTslGsdAsdTsmdCsdAsdGsdAsmdCsdAslCslTslC-3' (SEQ ID NO: 574).

In some embodiments, the antisense oligonucleotide targeting MYH7B comprises a sequence that is at least partially complementary or completely complementary to the sequence of human MYH7B gene from nucleotides 1182 to 1213 in SEQ ID NO: 6. In other embodiments, the antisense oligonucleotide targeting MYH7B comprises a sequence that is at least partially complementary or completely complementary to the sequence of human MYH7B gene from nucleotides 1365 to 1393 in SEQ ID NO: 6.

In one embodiment, the antisense oligonucleotide targeting MYH7B has a sequence of 5'-GTGAATGCGGATGAA-3' (SEQ ID NO: 1). In another embodiment, the antisense oligonucleotide of MYH7B has a sequence of 5'-GAAGTG-GTAGTCATA-3' (SEQ ID NO: 2). In yet another embodiment, the antisense oligonucleotide of MYH7B has a sequence of 5'-lGslTslGsdAsdAsdTsdGsdCsdGsdGsdAs-dTsdGslAslA-3' (SEQ ID NO: 3).

The term "about" as used herein encompasses variations of +/−10% and more preferably +/−5%, as such variations are appropriate for practicing the present invention.

In one embodiment, the antisense oligonucleotide inhibitor of MYH7B contains at least one backbone modification, such as at least one phosphorothioate, morpholino, or phosphonocarboxylate internucleotide linkage (see, for example, U.S. Pat. Nos. 6,693,187 and 7,067,641, which are herein incorporated by reference in their entireties). In some embodiments, the antisense oligonucleotide inhibitor of MYH7B contains two or more phosphorothioate linkages. In certain embodiments, the antisense oligonucleotide inhibitor of MYH7B is fully phosphorothioate-linked. Alternatively, the antisense oligonucleotides can comprise peptide nucleic acids (PNAs), which contain a peptide-based backbone rather than a sugar-phosphate backbone.

In one embodiment, the antisense oligonucleotide inhibitor of MYH7B contains at least one modified nucleotide such as a locked nucleotide or a nucleotide containing other sugar, base, and/or backbone modifications. The terms "locked nucleotide," "locked nucleic acid unit," "locked nucleic acid residue," "LNA unit", "bridged nucleic acid," "bridged nucleotide," "BNA" may be used interchangeably throughout the disclosure and refer to a bicyclic nucleoside/nucleotide analogue. Specifically, a "bridged nucleic acid" or "bridged nucleotide" refers to a nucleotide containing a bridge at the 2',4'-position or at the 3',4'-position of the sugar residue. For instance, suitable antisense oligonucleotide inhibitors can be comprised of one or more "conformationally constrained" or 2',4'-bridged nucleotide modifications that confer enhanced thermal stability to complexes formed between the oligonucleotide containing bridged nucleotides and their complementary target strand. In one embodiment, antisense oligonucleotide inhibitors contain a 2'-O, 4'-C-methylene bridge ribonucleoside (structure A), conventionally known as "locked nucleotide" or "LNA". In another embodiment, antisense oligonucleotide inhibitors contain at least one 2',4'-C-bridged 2' deoxyribonucleoside (CDNA, structure B). See, e.g., U.S. Pat. No. 6,403,566 and Wang et al. (1999) Bioorganic and Medicinal Chemistry Letters, Vol. 9: 1147-1150, both of which are herein incorporated by reference in their entireties. In yet another embodiment, antisense oligonucleotide inhibitors contain at least one modified nucleoside having the structure shown in structure C. In yet another embodiment, antisense oligonucleotide inhibitors contain at least one 2'O, 4'-C-ethylene bridge ribonucleoside (structure D). A nucleic acid or an oligonucleotide or a nucleotide containing the 2'O, 4'-C-ethylene bridge is also known as ethylene-bridged nucleic acid (ENA). In still another embodiment, antisense oligonucleotide inhibitors contain at least one 2'-$CH_2$—NH—$CH_2$-4'-bridged nucleotide, also known as "amino-2'-C-Bridged Bicyclic Nucleotide" or "amino-CBBN". The antisense oligonucleotide inhibitors targeting MYH7B can contain combinations of bridged nucleotides described above or other modified nucleotides, and unmodified ribonucleotides or deoxyribonucleotides.

When referring to substituting a DNA or RNA nucleotide by its corresponding bridged or locked nucleotide in the context of the present invention, the terms "corresponding bridged nucleotide" or "corresponding locked nucleotide" are intended to mean that the DNA/RNA nucleotide has been replaced by a bridged or locked nucleotide containing the same naturally-occurring nitrogenous base as the DNA/RNA nucleotide that it has replaced or the same nitrogenous base that is chemically modified. For example, the corresponding bridged or locked nucleotide of a DNA nucleotide containing the nitrogenous base C may contain the same nitrogenous base C or the same nitrogenous base C that is chemically modified, such as 5-methylcytosine.

The terms "non-bridged nucleotide" or "non-locked nucleotide" refer to a nucleotide different from a bridged or locked-nucleotide, i.e. the terms "non-bridged nucleotide" or "non-locked nucleotide" include a DNA nucleotide, an RNA nucleotide as well as a modified nucleotide where a base and/or sugar is modified except that the modification is not a bridge or locked modification.

In one embodiment, the antisense oligonucleotide inhibitor of MYH7B contains at least one locked nucleotide. In some embodiments, the antisense oligonucleotide inhibitor of MYH7B contains one to six locked nucleotides. In one embodiment, at least the first three nucleotides from the 3' end of the antisense oligonucleotide inhibitor are locked nucleotides. In another embodiment, at least the first three nucleotides from the 5' end of the antisense oligonucleotide inhibitor are locked nucleotides.

In certain embodiments, the antisense oligonucleotide inhibitor contains one to six natural or modified ribonucleotides. In one embodiment, at least the first three nucleotides from the 3' end of the antisense oligonucleotide inhibitor are natural or modified ribonucleotides. In another embodiment, at least the first three nucleotides from the 5' end of the antisense oligonucleotide inhibitor are natural or modified ribonucleotides. In some embodiments, the first three nucleotides from the 3' end of the antisense oligonucleotide inhibitor are locked ribonucleotides. In other embodiments, the first three nucleotides from the 5' end of the antisense oligonucleotide inhibitor are locked ribonucleotides.

Oligonucleotide inhibitors of the present invention may include modified nucleotides that have a base modification or substitution. The natural or unmodified bases are the purine bases adenine (A) and guanine (G), and the pyrimidine bases cytosine (C), thymine (T) and uracil (U). Modified bases, also referred to as heterocyclic base moieties, include other synthetic and natural nucleobases such as 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine and other alkynyl derivatives of pyrimidine bases, 6-azo uracil, cytosine and thymine, 5-uracil (pseudouracil), 4-thiouracil, 8-halo, 8-amino, 8-thiol, 8-thioalkyl, 8-hydroxyl and other 8-substituted adenines and guanines, 5-halo (including 5-bromo, 5-trifluoromethyl and other 5-substituted uracils and cytosines), 7-methylguanine and 7-methyladenine, 2-F-adenine, 2-amino-adenine, 8-azaguanine and 8-azaadenine, 7-deazaguanine and 7-deazaadenine and 3-deazaguanine and 3-deazaadenine. In one embodiment, antisense oligonucleotide inhibitors of the present invention comprise one to five 5-methylcytidine or 5-methyldeoxycytidine nucleotides. In certain embodiments, antisense oligonucleotide inhibitors comprise one or more bridged nucleic acid modifications

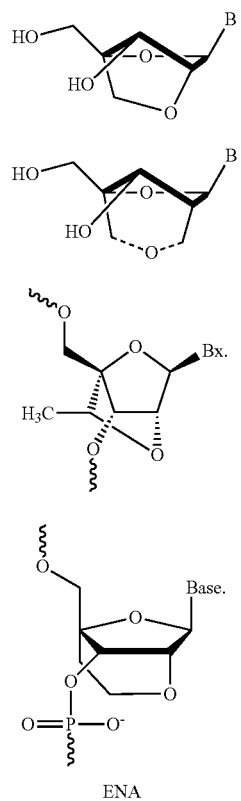

A

B

C

D

ENA (e.g. LNA, ENA, etc.) in combination with a base modification (e.g. 5-methyl cytidine).

Oligonucleotide inhibitors of the present invention may include nucleotides with modified sugar moieties. Representative modified sugars include carbocyclic or acyclic sugars, sugars having substituent groups at one or more of their 2', 3' or 4' positions and sugars having substituents in place of one or more hydrogen atoms of the sugar. In certain embodiments, the sugar is modified by having a substituent group at the 2' position. In additional embodiments, the sugar is modified by having a substituent group at the 3' position. In other embodiments, the sugar is modified by having a substituent group at the 4' position. It is also contemplated that a sugar may have a modification at more than one of those positions, or that an oligonucleotide inhibitor may have one or more nucleotides with a sugar modification at one position and also one or more nucleotides with a sugar modification at a different position.

Sugar modifications contemplated in the oligonucleotide inhibitors of the present invention include, but are not limited to, a substituent group selected from: OH; F; O-, S-, or N-alkyl; O-, S-, or N-alkenyl; O-, S- or N-alkynyl; or O-alkyl-O-alkyl, wherein the alkyl, alkenyl and alkynyl may be substituted or unsubstituted with $C_1$ to $C_{10}$ alkyl or $C_2$ to $C_{10}$ alkenyl and alkynyl. In one embodiment, the modification includes 2'-methoxyethoxy (2'-O—$CH_2CH_2OCH_3$, which is also known as 2'-O-(2-methoxyethyl) or 2'-MOE), that is, an alkoxyalkoxy group. Another modification includes 2'-dimethylaminooxyethoxy, that is, a O(CH$_2$)$_2$ON(CH$_3$)$_2$ group, also known as 2'-DMAOE and 2'-dimethylaminoethoxyethoxy (also known in the art as 2'-O-dimethylamino-ethoxy-ethyl or 2'-DMAEOE), that is, 2'-O—$CH_2$—O—$CH_2$—N(CH$_3$)$_2$.

Additional sugar substituent groups include allyl (—$CH_2$—CH=$CH_2$), —O-allyl, methoxy (—O—$CH_3$), aminopropoxy (—$OCH_2CH_2CH_2NH_2$), and fluoro (F). Sugar substituent groups on the 2' position (2'-) may be in the arabino (up) position or ribo (down) position. One 2'-arabino modification is 2'-F. Other similar modifications may also be made at other positions on the sugar moiety, particularly the 3' position of the sugar on the 3' terminal nucleoside or in 2'-5' linked oligonucleotides and the 5' position of 5' terminal nucleotide. In certain embodiments, the sugar modification is a 2'-O-alkyl (e.g. 2'-O-methyl, 2'-O-methoxyethyl), 2'-halo (e.g., 2'-fluoro, 2'-chloro, 2'-bromo), and 4' thio modifications.

Other modifications of oligonucleotide inhibitors to enhance stability and improve efficacy, such as those described in U.S. Pat. No. 6,838,283, which is herein incorporated by reference in its entirety, are known in the art and are suitable for use in the methods of the invention. For instance, to facilitate in vivo delivery and stability, the oligonucleotide inhibitor can be linked to a steroid, such as cholesterol moiety, a vitamin, a fatty acid, a carbohydrate or glycoside, a peptide, or other small molecule ligand at its 3' end. In some embodiments, the antisense oligonucleotide inhibitor is attached to a peptide to enhance the uptake of the inhibitor by target cells. For instance, in some embodiments, the 3' end of an antisense oligonucleotide inhibitor is attached to a peptide having the sequence "WLSEAGPVVTVRALRGTGSW (SEQ ID NO: 788)". This peptide is described in McGuire et al. ("In vitro selection of a peptide with high selectivity for cardiomyocytes in vivo", J. Mol. Bio, 2004, vol. 342, 171-182), which is hereby incorporated by reference herein. In one embodiment, the peptide is attached to the antisense oligo via a linker such as "thiolC3," whereby a thioether bond is formed between the SH group of the linker and the oligo and the maleimide on the peptide. In some embodiments, the 5'end of an antisense oligonucleotide inhibitor could be attached to a sugar moiety directly or via a linker. The linker could be a C6-disulfide linker or a 1-3 phosphodiester linker such as a phosphodiester dTdT linker.

In various embodiments, the antisense oligonucleotide of MYH7B has a sequence selected from Tables 1-5.

TABLE 1

| Starting nucleotide of target sequence in SEQ ID NO: 6 | Sequence(5'-3') | Sequence(5'-3') with modifications |
| --- | --- | --- |
| 733 | GTTCATGGGCTGCA (SEQ ID NO: 7) | lGslTslTsdCsdAsdTsdGsdGsdGsdGsdCsdTslGslCslA (SEQ ID NO: 8) |
| 734 | GGTTCATGGGCTGC (SEQ ID NO: 9) | lGslGslTsdTsdCsdAsdTsdGsdGsdGsdGsdCslTslGslC (SEQ ID NO: 10) |
| 735 | GGGTTCATGGGCTG (SEQ ID NO: 11) | lGslGslGsdTsdTsdCsdAsdTsdGsdGsdGsdGslCslTslG (SEQ ID NO: 12) |
| 867 | ATGGTGACACAGAA (SEQ ID NO: 13) | lAslTslGsdGsdTsdGsdAsdCsdAsdCsdAslGslAslA (SEQ ID NO: 14) |
| 1020 | ATCAGCATGGACTG (SEQ ID NO: 15) | lAslTslCsdAsdGsdCsdAsdTsdGsdGsdAslCslTslG (SEQ ID NO: 16) |
| 1061 | GCTTGGTGTTAACC (SEQ ID NO: 17) | lGslCslTsdTsdGsdGsdTsdGsdTsdTsdAslAslCslC (SEQ ID NO: 18) |
| 1188 | TCCATGGCAGGGTT (SEQ ID NO: 19) | lTslCslCsdAsdTsdGsdGsdCsdAsdGsdGslGslTslT (SEQ ID NO: 20) |
| 1189 | CTCCATGGCAGGGT (SEQ ID NO: 21) | lCslTslCsdCsdAsdTsdGsdGsdCsdAsdGslGslGslT (SEQ ID NO: 22) |

TABLE 1-continued

| Starting nucleotide of target sequence in SEQ ID NO: 6 | Sequence(5'-3') | Sequence(5'-3') with modifications |
|---|---|---|
| 1190 | CCTCCATGGCAGGG (SEQ ID NO: 23) | lCslCslTsdCsdCsdAsdTsdGsdGsdCsdAslGslGslG (SEQ ID NO: 24) |
| 1191 | GCCTCCATGGCAGG (SEQ ID NO: 25) | lGslCslCsdTsdCsdCsdAsdTsdGsdGsdCslAslGslG (SEQ ID NO: 26) |
| 1305 | AGATAGCTGTCAAT (SEQ ID NO: 27) | lAslGslAsdTsdAsdGsdCsdTsdGsdTsdCslAslAslT (SEQ ID NO: 28) |
| 1306 | GAGATAGCTGTCAA (SEQ ID NO: 29) | lGslAslGsdAsdTsdAsdGsdCsdTsdGsdTslCslAslA (SEQ ID NO: 30) |
| 1307 | GGAGATAGCTGTCA (SEQ ID NO: 31) | lGslGslAsdGsdAsdTsdAsdGsdCsdTsdGslTslCslA (SEQ ID NO: 32) |
| 1308 | AGGAGATAGCTGTC (SEQ ID NO: 33) | lAslGslGsdAsdGsdAsdTsdAsdGsdCsdTslGslTslC (SEQ ID NO: 34) |
| 1309 | CAGGAGATAGCTGT (SEQ ID NO: 35) | lCslAslGsdGsdAsdGsdAsdTsdAsdGsdCslTslGslT (SEQ ID NO: 36) |
| 1310 | CCAGGAGATAGCTG (SEQ ID NO: 37) | lCslCslAsdGsdGsdAsdGsdAsdTsdAsdGslCslTslG (SEQ ID NO: 38) |
| 1311 | TCCAGGAGATAGCT (SEQ ID NO: 39) | lTslCslCsdAsdGsdGsdAsdGsdAsdTsdAslGslCslT (SEQ ID NO: 40) |
| 1443 | CAGAAGTGGTAGTC (SEQ ID NO: 41) | lCslAslGsdAsdAsdGsdTsdGsdGsdTsdAslGslTslC (SEQ ID NO: 42) |
| 1445 | TGCAGAAGTGGTAG (SEQ ID NO: 43) | lTslGslCsdAsdGsdAsdAsdGsdTsdGsdGslTslAslG (SEQ ID NO: 44) |
| 1446 | CTGCAGAAGTGGTA (SEQ ID NO: 45) | lCslTslGsdCsdAsdGsdAsdAsdGsdTsdGslGslTslA (SEQ ID NO: 46) |
| 1647 | GCACTCTCAGTGCC (SEQ ID NO: 47) | lGslCslAsdCsdTsdCsdTsdCsdAsdGsdTslGslCslC (SEQ ID NO: 48) |
| 1662 | TAGGCAGCCTTGTC (SEQ ID NO: 49) | lTslAslGsdGsdCsdAsdGsdCsdCsdTsdTslGslTslC (SEQ ID NO: 50) |
| 1755 | ACACTCTGGCCCTT (SEQ ID NO: 51) | lAslCslAsdCsdTsdCsdTsdGsdGsdCsdCslCslTslT (SEQ ID NO: 52) |
| 1758 | TCCACACTCTGGCC (SEQ ID NO: 53) | lTslCslCsdAsdCsdAsdCsdTsdCsdTsdGslGslCslC (SEQ ID NO: 54) |
| 1759 | CTCCACACTCTGGC (SEQ ID NO: 55) | lCslTslCsdCsdAsdCsdAsdCsdTsdCsdTslGslGslC (SEQ ID NO: 56) |
| 1760 | GCTCCACACTCTGG (SEQ ID NO: 57) | lGslCslTsdCsdCsdAsdCsdAsdCsdTsdCslTslGslG (SEQ ID NO: 58) |
| 1761 | TGCTCCACACTCTG (SEQ ID NO: 59) | lTslGslCsdTsdCsdCsdAsdCsdAsdCsdTslCslTslG (SEQ ID NO: 60) |
| 1764 | ACCTGCTCCACACT (SEQ ID NO: 61) | lAslCslCsdTsdGsdCsdTsdCsdCsdAsdCslAslCslT (SEQ ID NO: 62) |
| 1766 | CCACCTGCTCCACA (SEQ ID NO: 63) | lCslCslAsdCsdCsdTsdGsdCsdTsdCsdCslAslCslA (SEQ ID NO: 64) |
| 1767 | ACCACCTGCTCCAC (SEQ ID NO: 65) | lAslCslCsdAsdCsdCsdTsdGsdCsdTsdCslCslAslC (SEQ ID NO: 66) |
| 1912 | CTCAAAGATCTCAA (SEQ ID NO: 67) | lCslTslCsdAsdAsdAsdGsdAsdTsdCsdTslCslAslA (SEQ ID NO: 68) |
| 1913 | ACTCAAAGATCTCA (SEQ ID NO: 69) | lAslCslTsdCsdAsdAsdAsdGsdAsdTsdCslTslCslA (SEQ ID NO: 70) |

TABLE 1-continued

| Starting nucleotide of target sequence in SEQ ID NO: 6 | Sequence(5'-3') | Sequence(5'-3') with modifications |
|---|---|---|
| 1914 | AACTCAAAGATCTC (SEQ ID NO: 71) | lAslAslCsdTsdCsdAsdAsdAsdGsdAsdTslCslTslC (SEQ ID NO: 72) |
| 2037 | ATGAAGACCCAGTC (SEQ ID NO: 73) | lAslTslGsdAsdAsdGsdAsdCsdCsdCsdAslGslTslC (SEQ ID NO: 74) |
| 2038 | GATGAAGACCCAGT (SEQ ID NO: 75) | lGslAslTsdGsdAsdAsdGsdAsdCsdCsdCslAslGslT (SEQ ID NO: 76) |
| 2253 | TAGTGGACCACCTC (SEQ ID NO: 77) | lTslAslGsdTsdGsdGsdAsdCsdCsdAsdCslCslTslC (SEQ ID NO: 78) |
| 2481 | AGGTTCTCCTTGTG (SEQ ID NO: 79) | lAslGslGsdTsdTsdCsdTsdCsdCsdTsdTslGslTslG (SEQ ID NO: 80) |
| 2482 | GAGGTTCTCCTTGT (SEQ ID NO: 81) | lGslAslGsdGsdTsdTsdCsdTsdCsdCsdTslTslGslT (SEQ ID NO: 82) |
| 2483 | TGAGGTTCTCCTTG (SEQ ID NO: 83) | lTslGslAsdGsdGsdTsdTsdCsdTsdCsdCslTslTslG (SEQ ID NO: 84) |
| 2484 | TTGAGGTTCTCCTT (SEQ ID NO: 85) | lTslTslGsdAsdGsdGsdTsdTsdCsdTsdCslCslTslT (SEQ ID NO: 86) |
| 2485 | GTTGAGGTTCTCCT (SEQ ID NO: 87) | lGslTslTsdGsdAsdGsdGsdTsdTsdCsdTslCslCslT (SEQ ID NO: 88) |
| 2488 | CTTGTTGAGGTTCT (SEQ ID NO: 89) | lCslTslTsdGsdTsdTsdGsdAsdGsdGsdTslTslCslT (SEQ ID NO: 90) |
| 2518 | GGGCTGTGTGGCCC (SEQ ID NO: 91) | lGslGslGsdCsdTsdGsdTsdGsdTsdGsdGslCslCslC (SEQ ID NO: 92) |
| 2738 | CCTTCCTGCTGTCC (SEQ ID NO: 93) | lCslCslTsdTsdCsdCsdTsdGsdCsdTsdGslTslCslC (SEQ ID NO: 94) |
| 2740 | GGCCTTCCTGCTGT (SEQ ID NO: 95) | lGslGslCsdCsdTsdTsdCsdCsdTsdGsdCslTslGslT (SEQ ID NO: 96) |
| 2961 | TGGATGGTGAACAG (SEQ ID NO: 97) | lTslGslGsdAsdTsdGsdGsdTsdGsdAsdAslCslAslG (SEQ ID NO: 98) |
| 2962 | CTGGATGGTGAACA (SEQ ID NO: 99) | lCslTslGsdGsdAsdTsdGsdGsdTsdGsdAslAslCslA (SEQ ID NO: 100) |
| 2964 | CACTGGATGGTGAA (SEQ ID NO: 101) | lCslAslCsdTsdGsdGsdAsdTsdGsdGsdTslGslAslA (SEQ ID NO: 102) |
| 2966 | TCCACTGGATGGTG (SEQ ID NO: 103) | lTslCslCsdAsdCsdTsdGsdGsdAsdTsdGslGslTslG (SEQ ID NO: 104) |
| 2967 | TTCCACTGGATGGT (SEQ ID NO: 105) | lTslTslCsdCsdAsdCsdTsdGsdGsdAsdTslGslGslT (SEQ ID NO: 106) |
| 3186 | TGCAGGGCCAGGTC (SEQ ID NO: 107) | lTslGslCsdAsdGsdGsdGsdCsdCsdAsdGslGslTslC (SEQ ID NO: 108) |
| 3187 | CTGCAGGGCCAGGT (SEQ ID NO: 109) | lCslTslGsdCsdAsdGsdGsdGsdCsdCsdAslGslGslT (SEQ ID NO: 110) |
| 3255 | ACCTTGGACTTGAT (SEQ ID NO: 111) | lAslCslCsdTsdTsdGsdGsdAsdCsdTsdTslGslAslT (SEQ ID NO: 112) |
| 3257 | GCACCTTGGACTTG (SEQ ID NO: 113) | lGslCslAsdCsdCsdTsdTsdGsdGsdAsdCslTslTslG (SEQ ID NO: 114) |
| 3258 | TGCACCTTGGACTT (SEQ ID NO: 115) | lTslGslCsdAsdCsdCsdTsdTsdGsdGsdAslCslTslT (SEQ ID NO: 116) |
| 3259 | CTGCACCTTGGACT (SEQ ID NO: 117) | lCslTslGsdCsdAsdCsdCsdTsdTsdGsdGslAslCslT (SEQ ID NO: 118) |

TABLE 1-continued

| Starting nucleotide of target sequence in SEQ ID NO: 6 | Sequence(5'-3') | Sequence(5'-3') with modifications |
|---|---|---|
| 3260 | GCTGCACCTTGGAC (SEQ ID NO: 119) | lGslCslTsdGsdCsdAsdCsdCsdTsdTsdGslGslAslC (SEQ ID NO: 120) |
| 3261 | AGCTGCACCTTGGA (SEQ ID NO: 121) | lAslGslCsdTsdGsdCsdAsdCsdCsdTsdTslGslGslA (SEQ ID NO: 122) |
| 4253 | CTGCACTGGCCTTG (SEQ ID NO: 123) | lCslTslGsdCsdAsdCsdTsdGsdGsdCslTslTslG (SEQ ID NO: 124) |
| 4254 | TCTGCACTGGCCTT (SEQ ID NO: 125) | lTslCslTsdGsdCsdAsdCsdTsdGsdGsdCslCslTslT (SEQ ID NO: 126) |
| 4255 | CTCTGCACTGGCCT (SEQ ID NO: 127) | lCslTslCsdTsdGsdCsdAsdCsdTsdGsdGslCslCslT (SEQ ID NO: 128) |
| 4256 | TCTCTGCACTGGCC (SEQ ID NO: 129) | lTslCslTsdCsdTsdGsdCsdAsdCsdTsdGslGslCslC (SEQ ID NO: 130) |
| 4257 | TTCTCTGCACTGGC (SEQ ID NO: 131) | lTslTslCsdTsdCsdTsdGsdCsdAsdCsdTslGslGslC (SEQ ID NO: 132) |
| 4258 | CTTCTCTGCACTGG (SEQ ID NO: 133) | lCslTslTsdCsdTsdCsdTsdGsdCsdAsdCslTslGslG (SEQ ID NO: 134) |
| 4259 | GCTTCTCTGCACTG (SEQ ID NO: 135) | lGslCslTsdTsdCsdTsdCsdTsdGsdCsdAslCslTslG (SEQ ID NO: 136) |
| 4260 | AGCTTCTCTGCACT (SEQ ID NO: 137) | lAslGslCsdTsdTsdCsdTsdCsdTsdGsdCslAslCslT (SEQ ID NO: 138) |
| 4261 | CAGCTTCTCTGCAC (SEQ ID NO: 139) | lCslAslGsdCsdTsdTsdCsdTsdCsdTsdGslCslAslC (SEQ ID NO: 140) |
| 4262 | ACAGCTTCTCTGCA (SEQ ID NO: 141) | lAslCslAsdGsdCsdTsdTsdCsdTsdCsdTslGslCslA (SEQ ID NO: 142) |
| 4263 | CACAGCTTCTCTGC (SEQ ID NO: 143) | lCslAslCsdAsdGsdCsdTsdTsdCsdTsdCslTslGslC (SEQ ID NO: 144) |
| 4302 | TTGATCTTGGCCTC (SEQ ID NO: 145) | lTslTslGsdAsdTsdCsdTsdTsdGsdGsdCslCslTslC (SEQ ID NO: 146) |
| 4318 | CTGCAGCTCCTCCA (SEQ ID NO: 147) | lCslTslGsdCsdAsdGsdCsdTsdCsdCsdTslCslCslA (SEQ ID NO: 148) |
| 4717 | TGCCTCCTGCAGCC (SEQ ID NO: 149) | lTslGslCsdCsdTsdCsdCsdTsdGsdCsdAslGslCslC (SEQ ID NO: 150) |
| 4773 | AGCTTGGCCTTCTC (SEQ ID NO: 151) | lAslGslCsdTsdTsdGsdGsdCsdCsdTsdTslCslTslC (SEQ ID NO: 152) |
| 4904 | TCTCCTCCTCCTGC (SEQ ID NO: 153) | lTslCslTsdCsdCsdTsdCsdCsdTsdCsdCslTslGslC (SEQ ID NO: 154) |
| 6099 | AGGTTCTTCCTGTC (SEQ ID NO: 155) | lAslGslGsdTsdTsdCsdTsdTsdCsdCsdTslGslTslC (SEQ ID NO: 156) |
| 6101 | CCAGGTTCTTCCTG (SEQ ID NO: 157) | lCslCslAsdGsdGsdTsdTsdCsdTsdTsdCslCslTslG (SEQ ID NO: 158) |
| 6102 | GCCAGGTTCTTCCT (SEQ ID NO: 159) | lGslCslCsdAsdGsdGsdTsdTsdCsdTsdTslCslCslT (SEQ ID NO: 160) |
| 6103 | AGCCAGGTTCTTCC (SEQ ID NO: 161) | lAslGslCsdCsdAsdGsdGsdTsdTsdCsdTslTslCslC (SEQ ID NO: 162) |
| 6104 | GAGCCAGGTTCTTC (SEQ ID NO: 163) | lGslAslGsdCsdCsdAsdGsdGsdTsdTsdCslTslTslC (SEQ ID NO: 164) |
| 6142 | GACCTTGCTCTGCA (SEQ ID NO: 165) | lGslAslCsdCsdTsdTsdGsdCsdTsdCsdTslGslCslA (SEQ ID NO: 166) |

TABLE 1-continued

| Starting nucleotide of target sequence in SEQ ID NO: 6 | Sequence(5'-3') | Sequence(5'-3') with modifications |
|---|---|---|
| 6143 | TGACCTTGCTCTGC (SEQ ID NO: 167) | lTslGslAsdCsdCsdTsdTsdGsdCsdTsdCslTslGslC (SEQ ID NO: 168) |
| 6144 | TTGACCTTGCTCTG (SEQ ID NO: 169) | lTslTslGsdAsdCsdCsdTsdTsdGsdCsdTslCslTslG (SEQ ID NO: 170) |
| 6146 | TCTTGACCTTGCTC (SEQ ID NO: 171) | lTslCslTsdTsdGsdAsdCsdCsdTsdTsdGslCslTslC (SEQ ID NO: 172) |
| 6149 | AGCTCTTGACCTTG (SEQ ID NO: 173) | lAslGslCsdTsdCsdTsdTsdGsdAsdCsdCslTslTslG (SEQ ID NO: 174) |
| 6151 | GTAGCTCTTGACCT (SEQ ID NO: 175) | lGslTslAsdGsdCsdTsdCsdTsdTsdGsdAslCslCslT (SEQ ID NO: 176) |
| 6220 | GTGCTGGGCCTTGC (SEQ ID NO: 177) | lGslTslGsdCsdTsdGsdGsdGsdCsdCsdTslTslGslC (SEQ ID NO: 178) |
| 6273 | TTGTTGGCCTGGGT (SEQ ID NO: 179) | lTslTslGsdTsdTsdGsdGsdCsdCsdTsdGslGslGslT (SEQ ID NO: 180) |
| 6277 | CAGCTTGTTGGCCT (SEQ ID NO: 181) | lCslAslGsdCsdTsdTsdGsdTsdTsdGsdGslCslCslT (SEQ ID NO: 182) |
| | GTGAATGCGGATGAA (SEQ ID NO: 1) | lGslTslGsdAsdAsdTsdGsdCsdGsdGsdAsdTsdGslA slA (SEQ ID NO: 3) | l = locked nucleotide;
d = deoxynucleotide;
s = phosphorotioate linkage.

TABLE 2

| Starting nucleotide of target sequence in SEQ ID NO: 6 | Sequence (5'-3') | Sequence (5'-3') with modifications |
|---|---|---|
| 513 | TCACTCACATCCAT (SEQ ID NO: 183) | lTslCslAsmdCsdTsmdCsdAsmdCsdAsdTsmdCslCslAslT (SEQ ID NO: 184) |
| 514 | TTCACTCACATCCA (SEQ ID NO: 185) | lTslTslCsdAsmdCsdTsmdCsdAsmdCsdAsdTslCslCslA (SEQ ID NO: 186) |
| 515 | GTTCACTCACATCC (SEQ ID NO: 187) | lGslTslTsmdCsdAsmdCsdTsmdCsdAsmdCsdAslTslCslC (SEQ ID NO: 188) |
| 516 | AGTTCACTCACATC (SEQ ID NO: 189) | lAslGslTsdTsmdCsdAsmdCsdTsmdCsdAsmdCslAslTslC (SEQ ID NO: 190) |
| 517 | AAGTTCACTCACAT (SEQ ID NO: 191) | lAslAslGsdTsdTsmdCsdAsmdCsdTsmdCsdAslCslAslT (SEQ ID NO: 192) |
| 518 | CAAGTTCACTCACA (SEQ ID NO: 193) | lCslAslAsdGsdTsdTsmdCsdAsmdCsdTsmdCslAslCslA (SEQ ID NO: 194) |
| 519 | CCAAGTTCACTCAC (SEQ ID NO: 195) | lCslCslAsdAsdGsdTsdTsmdCsdAsmdCsdTslCslAslC (SEQ ID NO: 196) |
| 520 | CCCAAGTTCACTCA (SEQ ID NO: 197) | lCslCslCsdAsdAsdGsdTsdTsmdCsdAsmdCslTslCslA (SEQ ID NO: 198) |
| 521 | CCCCAAGTTCACTC (SEQ ID NO: 199) | lCslCslCsmdCsdAsdAsdGsdTsdTsmdCsdAslCslTslC (SEQ ID NO: 200) |
| 522 | TCCCCAAGTTCACT (SEQ ID NO: 201) | lTslCslCsmdCsmdCsdAsdAsdGsdTsdTsmdCslAslCslT (SEQ ID NO: 202) |

TABLE 2-continued

| Starting nucleotide of target sequence in SEQ ID NO: 6 | Sequence (5'-3') | Sequence (5'-3') with modifications |
|---|---|---|
| 523 | CTCCCCAAGTTCAC (SEQ ID NO: 203) | lCslTslCsmdCsmdCsmdCsdAsdAsdGsdTsdTslCslAslC (SEQ ID NO: 204) |
| 524 | ACTCCCCAAGTTCA (SEQ ID NO: 205) | lAslCslTsmdCsmdCsmdCsmdCsdAsdAsdGsdTslTslCslA (SEQ ID NO: 206) |
| 525 | GACTCCCCAAGTTC (SEQ ID NO: 207) | lGslAslCsdTsmdCsmdCsmdCsmdCsdAsdAsdGslTslTslC (SEQ ID NO: 208) |
| 526 | AGACTCCCCAAGTT (SEQ ID NO: 209) | lAslGslAsmdCsdTsmdCsmdCsmdCsmdCsdAsdAslGslTslT (SEQ ID NO: 210) |
| 527 | CAGACTCCCCAAGT (SEQ ID NO: 211) | lCslAslGsdAsmdCsdTsmdCsmdCsmdCsmdCsdAslAslGslT (SEQ ID NO: 212) |
| 528 | GCAGACTCCCCAAG (SEQ ID NO: 213) | lGslCslAsdGsdAsmdCsdTsmdCsmdCsmdCsmdCslAslAslG (SEQ ID NO: 214) |
| 610 | AGGCACCCAGACTC (SEQ ID NO: 215) | lAslGslGsmdCsdAsmdCsmdCsmdCsdAsdGsdAslCslTslC (SEQ ID NO: 216) |
| 611 | CAGGCACCCAGACT (SEQ ID NO: 217) | lCslAslGsdGsmdCsdAsmdCsmdCsmdCsdAsdGslAslCslT (SEQ ID NO: 218) |
| 612 | TCAGGCACCCAGAC (SEQ ID NO: 219) | lTslCslAsdGsdGsmdCsdAsmdCsmdCsmdCsdAslGslAslC (SEQ ID NO: 220) |
| 613 | ATCAGGCACCCAGA (SEQ ID NO: 221) | lAslTslCsdAsdGsdGsmdCsdAsmdCsmdCsmdCslAslGslA (SEQ ID NO: 222) |
| 1447 | GCTGCAGAAGTGGT (SEQ ID NO: 223) | lGslCslTsdGsmdCsdAsdGsdAsdAsdGsdTslGslGslT (SEQ ID NO: 224) |
| 1518 | ATGTCCATGGCATG (SEQ ID NO: 225) | lAslTslGsdTsmdCsmdCsdAsdTsdGsdGsmdCslAslTslG (SEQ ID NO: 226) |
| 1560 | ATCTTATAGCAGGC (SEQ ID NO: 227) | lAslTslCsdTsdTsdAsdTsdAsdGsmdCsdAslGslGslC (SEQ ID NO: 228) |
| 1645 | ACTCTCAGTGCCAT (SEQ ID NO: 229) | lAslCslTsmdCsdTsmdCsdAsdGsdTsdGsmdCslCslAslT (SEQ ID NO: 230) |
| 1646 | CACTCTCAGTGCCA (SEQ ID NO: 231) | lCslAslCsdTsmdCsdTsmdCsdAsdGsdTsdGslCslCslA (SEQ ID NO: 232) |
| 1648 | AGCACTCTCAGTGC (SEQ ID NO: 233) | lAslGslCsdAsmdCsdTsmdCsdTsmdCsdAsdGslTslGslC (SEQ ID NO: 234) |
| 1649 | CAGCACTCTCAGTG (SEQ ID NO: 235) | lCslAslGsmdCsdAsmdCsdTsmdCsdTsmdCsdAslGslTslG (SEQ ID NO: 236) |
| 1650 | TCAGCACTCTCAGT (SEQ ID NO: 237) | lTslCslAsdGsmdCsdAsmdCsdTsmdCsdTsmdCslAslGslT (SEQ ID NO: 238) |
| 1651 | GTCAGCACTCTCAG (SEQ ID NO: 239) | lGslTslCsdAsdGsmdCsdAsmdCsdTsmdCsdTslCslAslG (SEQ ID NO: 240) |
| 1652 | TGTCAGCACTCTCA (SEQ ID NO:241 ) | lTslGslTsmdCsdAsdGsmdCsdAsmdCsdTsmdCslTslCslA (SEQ ID NO: 242) |
| 1655 | CCTTGTCAGCACTC (SEQ ID NO: 243) | lCslCslTsdTsdGsdTsmdCsdAsdGsmdCsdAslCslTslC (SEQ ID NO: 244) |
| 1682 | CACTGCTGACCCCC (SEQ ID NO: 245) | lCslAslCsdTsdGsmdCsdTsdGsdAsmdCsmdCslCslCslC (SEQ ID NO: 246) |
| 1683 | CCACTGCTGACCCC (SEQ ID NO: 247) | lCslCslAsmdCsdTsdGsmdCsdTsdGsdAsmdCslCslCslC (SEQ ID NO: 248) |
| 1684 | CCCACTGCTGACCC (SEQ ID NO: 249) | lCslCslCsdAsmdCsdTsdGsmdCsdTsdGsdAslCslCslC (SEQ ID NO: 250) |

TABLE 2-continued

| Starting nucleotide of target sequence in SEQ ID NO: 6 | Sequence (5'-3') | Sequence (5'-3') with modifications |
|---|---|---|
| 1685 | CCCCACTGCTGACC (SEQ ID NO: 251) | lCslCslCsmdCsdAsmdCsdTsdGsmdCsdTsdGslAslCslC (SEQ ID NO: 252) |
| 1686 | TCCCCACTGCTGAC (SEQ ID NO: 253) | lTslCslCsmdCsmdCsdAsmdCsdTsdGsmdCsdTslGslAslC (SEQ ID NO: 254) |
| 1687 | GTCCCCACTGCTGA (SEQ ID NO: 255) | lGslTslCsmdCsmdCsmdCsdAsmdCsdTsdGsmdCslTslGslA (SEQ ID NO: 256) |
| 1688 | GGTCCCCACTGCTG (SEQ ID NO: 257) | lGslGslTsmdCsmdCsmdCsmdCsdAsmdCsdTsdGslCslTslG (SEQ ID NO: 258) |
| 1689 | AGGTCCCCACTGCT (SEQ ID NO: 259) | lAslGslGsdTsmdCsmdCsmdCsmdCsdAsmdCsdTslGslCslT (SEQ ID NO: 260) |
| 1690 | GAGGTCCCCACTGC (SEQ ID NO: 261) | lGslAslGsdGsdTsmdCsmdCsmdCsmdCsdAsmdCslTslGslC (SEQ ID NO: 262) |
| 1691 | GGAGGTCCCCACTG (SEQ ID NO: 263) | lGslGslAsdGsdGsdTsmdCsmdCsmdCsmdCsdAslCslTslG (SEQ ID NO: 264) |
| 1692 | AGGAGGTCCCCACT (SEQ ID NO: 265) | lAslGslGsdAsdGsdGsdTsmdCsmdCsmdCslCslAslCslT (SEQ ID NO: 266) |
| 1693 | GAGGAGGTCCCCAC (SEQ ID NO: 267) | lGslAslGsdGsdAsdGsdGsdTsmdCsmdCsmdCslCslAslC (SEQ ID NO: 268) |
| 1694 | TGAGGAGGTCCCCA (SEQ ID NO: 269) | lTslGslAsdGsdGsdAsdGsdGsdTsmdCsmdCslCslCslA (SEQ ID NO: 270) |
| 1696 | TTTGAGGAGGTCCC (SEQ ID NO: 271) | lTslTslTsdGsdAsdGsdGsdAsdGsdGsdTslCslCslC (SEQ ID NO: 272) |
| 1702 | AAGGCCTTTGAGGA (SEQ ID NO: 273) | lAslAslGsdGsmdCsmdCsdTsdTsdTsdGsdAslGslGslA (SEQ ID NO: 274) |
| 1773 | GCAAACACCACCTG (SEQ ID NO: 275) | lGslCslAsdAsdAsmdCsdAsmdCsmdCsdAsmdCslCslTslG (SEQ ID NO: 276) |
| 1774 | AGCAAACACCACCT (SEQ ID NO: 277) | lAslGslCsdAsdAsdAsmdCsdAsmdCsmdCsdAslCslCslT (SEQ ID NO: 278) |
| 1775 | CAGCAAACACCACC (SEQ ID NO:279 ) | lCslAslGsmdCsdAsdAsdAsmdCsdAsmdCslAslCslC (SEQ ID NO: 280) |
| 1776 | ACAGCAAACACCAC (SEQ ID NO: 281) | lAslCslAsdGsmdCsdAsdAsdAsmdCsdAsmdCslCslAslC (SEQ ID NO: 282) |
| 1828 | AGACACCAGCCACC (SEQ ID NO: 283) | lAslGslAsmdCsdAsmdCsmdCsdAsdGsmdCsmdCslAslCslC (SEQ ID NO: 284) |
| 1829 | GAGACACCAGCCAC (SEQ ID NO: 285) | lGslAslGsdAsmdCsdAsmdCsmdCsdAsdGsmdCslCslAslC (SEQ ID NO: 286) |
| 2218 | CTTCTTGTCAGGCC (SEQ ID NO: 287) | lCslTslTsmdCsdTsdTsdGsdTsmdCsdAsdGslCslCslC (SEQ ID NO: 288) |
| 2238 | AAGTGGGCCTGGTA (SEQ ID NO: 289) | lAslAslGsdTsdGsdGsdGsmdCsmdCsdTsdGslGslTslA (SEQ ID NO: 290) |
| 2254 | GTAGTGGACCACCT (SEQ ID NO: 291) | lGslTslAsdGsdTsdGsdGsdAsmdCsmdCsdAslCslCslT (SEQ ID NO: 292) |
| 2574 | GCATCCATGACCCC (SEQ ID NO: 293) | lGslCslAsdTsmdCsmdCsdAsdTsdGsdAsmdCslCslCslC (SEQ ID NO: 294) |
| 2575 | GGCATCCATGACCC (SEQ ID NO: 295) | lGslGslCsdAsdTsmdCsmdCsdAsdTsdGsdAslCslCslC (SEQ ID NO: 296) |
| 2576 | AGGCATCCATGACC (SEQ ID NO: 297) | lAslGslGsmdCsdAsdTsmdCsmdCsdAsdTsdGslAslCslC (SEQ ID NO: 298) |

TABLE 2-continued

| Starting nucleotide of target sequence in SEQ ID NO: 6 | Sequence (5'-3') | Sequence (5'-3') with modifications |
|---|---|---|
| 2577 | AAGGCATCCATGAC (SEQ ID NO: 299) | lAslAslGsdGsmdCsdAsdTsmdCsmdCsdAsdTslGslAslC (SEQ ID NO: 300) |
| 4281 | TGATCCTCATAGGT (SEQ ID NO: 301) | lTslGslAsdTsmdCsmdCsdTsmdCsdAsdTsdAslGslGslT (SEQ ID NO: 302) |
| 4282 | CTGATCCTCATAGG (SEQ ID NO: 303) | lCslTslGsdAsdTsmdCsmdCsdTsmdCsdAsdTslAslGslG (SEQ ID NO: 304) |
| 4283 | GCTGATCCTCATAG (SEQ ID NO: 305) | lGslCslTsdGsdAsdTsmdCsmdCsdTsmdCsdAslTslAslG (SEQ ID NO: 306) |
| 4284 | AGCTGATCCTCATA (SEQ ID NO: 307) | lAslGslCsdTsdGsdAsdTsmdCsmdCsdTsmdCslAslTslA (SEQ ID NO: 308) |
| 4305 | ACCTTGATCTTGGC (SEQ ID NO: 309) | lAslCslCsdTsdTsdGsdAsdTsmdCsdTsdTslGslGslC (SEQ ID NO: 310) |
| 4656 | ATGGCATCTGCTTC (SEQ ID NO: 311) | lAslTslGsdGsmdCsdAsdTsmdCsdTsdGsmdCslTslTslC (SEQ ID NO: 312) |
| 4657 | GATGGCATCTGCTT (SEQ ID NO: 313) | lGslAslTsdGsdGsmdCsdAsdTsmdCsdTsdGslCslTslT (SEQ ID NO: 314) |
| 4661 | TCTGGATGGCATCT (SEQ ID NO: 315) | lTslCslTsdGsdGsdAsdTsdGsdGsmdCsdAslTslCslT (SEQ ID NO: 316) |
| 6141 | ACCTTGCTCTGCAG (SEQ ID NO: 317) | lAslCslCsdTsdTsdGsmdCsdTsmdCsdTsdGslCslAslG (SEQ ID NO: 318) |
| 436 | AGGCAGCAGGCACT (SEQ ID NO: 319) | lAslGslGsmdCsdAsdGsmdCsdAsdGsdGsmdCslAslCslT (SEQ ID NO: 320) |
| 437 | AAGGCAGCAGGCAC (SEQ ID NO: 321) | lAslAslGsdGsmdCsdAsdGsmdCsdAsdGsdGslCslAslC (SEQ ID NO: 322) |
| 438 | CAAGGCAGCAGGCA (SEQ ID NO: 323) | lCslAslAsdGsdGsmdCsdAsdGsmdCsdAsdGslGslCslA (SEQ ID NO: 324) |
| 439 | CCAAGGCAGCAGGC (SEQ ID NO: 325) | lCslCslAsdAsdGsdGsmdCsdAsdGsmdCsdAslGslGslC (SEQ ID NO: 326) |
| 482 | GGTGAAGGAGGAGG (SEQ ID NO: 327) | lGslGslTsdGsdAsdAsdGsdGsdAsdGsdGslAslGslG (SEQ ID NO: 328) |
| 483 | GGGTGAAGGAGGAG (SEQ ID NO: 329) | lGslGslGsdTsdGsdAsdAsdGsdGsdAsdGslGslAslG (SEQ ID NO: 330) |
| 509 | TCACATCCATCATG (SEQ ID NO: 331) | lTslCslAsmdCsdAsdTsmdCsmdCsdAsdTsmdCslAslTslG (SEQ ID NO: 332) |
| 511 | ACTCACATCCATCA (SEQ ID NO: 333) | lAslCslTsmdCsdAsmdCsdAsdTsmdCsmdCsdAslTslCslA (SEQ ID NO: 334) |
| 512 | CACTCACATCCATC (SEQ ID NO: 335) | lCslAslCsdTsmdCsdAsmdCsdAsdTsmdCsmdCslAslTslC (SEQ ID NO: 336) |
| 616 | TTCATCAGGCACCC (SEQ ID NO: 337) | lTslTslCsdAsdTsmdCsdAsdGsdGsmdCsdAslCslCslC (SEQ ID NO: 338) |
| 617 | GTTCATCAGGCACC (SEQ ID NO: 339) | lGslTslTsmdCsdAsdTsmdCsdAsdGsdGsmdCslAslCslC (SEQ ID NO: 340) |
| 622 | GTCCTGTTCATCAG (SEQ ID NO: 341) | lGslTslCsmdCsdTsdGsdTsdTsmdCsdAsdTslCslAslG (SEQ ID NO: 342) |
| 690 | TGGTCTTTGGTCTC (SEQ ID NO: 343) | lTslGslGsdTsmdCsdTsdTsdTsdGsdGsdTslCslTslC (SEQ ID NO: 344) |
| 804 | TTGTGCAGCACAGA (SEQ ID NO: 345) | lTslTslGsdTsdGsmdCsdAsdGsmdCsdAsmdCslAslGslA (SEQ ID NO: 346) |

TABLE 2-continued

| Starting nucleotide of target sequence in SEQ ID NO: 6 | Sequence (5'-3') | Sequence (5'-3') with modifications |
|---|---|---|
| 805 | GTTGTGCAGCACAG (SEQ ID NO: 347) | lGslTslTsdGsdTsdGsmdCsdAsdGsmdCsdAslCslAslG (SEQ ID NO: 348) |
| 892 | GACTGGGAGCCATT (SEQ ID NO: 349) | lGslAslCsdTsdGsdGsdGsdAsdGsmdCsmdCslAslTslT (SEQ ID NO: 350) |
| 893 | AGACTGGGAGCCAT (SEQ ID NO: 351) | lAslGslAsmdCsdTsdGsdGsdGsdAsdGsmdCslCslAslT (SEQ ID NO: 352) |
| 1102 | GTCTCCCAGGGCAG (SEQ ID NO: 353) | lGslTslCsdTsmdCsmdCsmdCsdAsdGsdGsdGslCslAslG (SEQ ID NO: 354) |
| 1215 | CTCAGGGTCTTGGC (SEQ ID NO: 355) | lCslTslCsdAsdGsdGsdGsdTsmdCsdTsdTslGslGslC (SEQ ID NO: 356) |
| 1216 | CCTCAGGGTCTTGG (SEQ ID NO: 357) | lCslCslTsmdCsdAsdGsdGsdGsdTsmdCsdTslTslGslG (SEQ ID NO: 358) |
| 1217 | TCCTCAGGGTCTTG (SEQ ID NO: 359) | lTslCslCsdTsmdCsdAsdGsdGsdGsdTsmdCslTslTslG (SEQ ID NO: 360) |
| 1219 | ATTCCTCAGGGTCT (SEQ ID NO: 361) | lAslTslTsmdCsmdCsdTsmdCsdAsdGsdGsdGslTslCslT (SEQ ID NO: 362) |
| 1220 | CATTCCTCAGGGTC (SEQ ID NO: 363) | lCslAslTsdTsmdCsmdCsdTsmdCsdAsdGsdGslGslTslC (SEQ ID NO: 364) |
| 1222 | ATCATTCCTCAGGG (SEQ ID NO: 365) | lAslTslCsdAsdTsdTsmdCsmdCsdTsmdCsdAslGslGslG (SEQ ID NO: 366) |
| 1225 | GTTATCATTCCTCA (SEQ ID NO: 366) | lGslTslTsdAsdTsmdCsdAsdTsdTsmdCsmdCslTslCslA (SEQ ID NO: 368) |
| 1226 | AGTTATCATTCCTC (SEQ ID NO: 369) | lAslGslTsdTsdAsdTsmdCsdAsdTsdTsmdCslCslTslC (SEQ ID NO: 370) |
| 1268 | AGGGACCAAAGTGA (SEQ ID NO: 371) | lAslGslGsdGsdAsmdCsmdCsdAsdAsdAsdGslTslGslA (SEQ ID NO: 372) |
| 1273 | CCCAGAGGGACCAA (SEQ ID NO: 373) | lCslCslCsdAsdGsdAsdGsdGsdGsdAsmdCslCslAslA (SEQ ID NO: 374) |
| 1274 | TCCCAGAGGGACCA (SEQ ID NO: 375) | lTslCslCsmdCsdAsdGsdAsdGsdGsdGsdAslCslCslA (SEQ ID NO: 376) |
| 1275 | TTCCCAGAGGGACC (SEQ ID NO: 377) | lTslTslCsmdCsmdCsdAsdGsdAsdGsdGsdGslAslCslC (SEQ ID NO: 378) |
| 1276 | CTTCCCAGAGGGAC (SEQ ID NO: 379) | lCslTslTsmdCsmdCsmdCsdAsdGsdAsdGsdGslGslAslC (SEQ ID NO: 380) |
| 1277 | GCTTCCCAGAGGGA (SEQ ID NO: 381) | lGslCslTsdTsmdCsmdCsmdCsdAsdGsdAsdGslGslGslA (SEQ ID NO: 382) |
| 1301 | AGCTGTCAATATCC (SEQ ID NO: 383) | lAslGslCsdTsdGsdTsmdCsdAsdAsdTsdAslTslCslC (SEQ ID NO: 384) |
| 1302 | TAGCTGTCAATATC (SEQ ID NO: 385) | lTslAslGsmdCsdTsdGsdTsmdCsdAsdAsdTslAslTslC (SEQ ID NO: 386) |
| 1303 | ATAGCTGTCAATAT (SEQ ID NO: 387) | lAslTslAsdGsmdCsdTsdGsdTsmdCsdAsdAslTslAslT (SEQ ID NO: 388) |
| 1304 | GATAGCTGTCAATA (SEQ ID NO: 389) | lGslAslTsdAsdGsmdCsdTsdGsdTsmdCsdAslAslTslA (SEQ ID NO: 390) |
| 1379 | CTGAGAGGATCTGG (SEQ ID NO: 391) | lCslTslGsdAsdGsdAsdGsdGsdAsdTsmdCslTslGslG (SEQ ID NO: 392) |
| 1380 | CCTGAGAGGATCTG (SEQ ID NO: 393) | lCslCslTsdGsdAsdGsdAsdGsdGsdAsdTslCslTslG (SEQ ID NO: 394) |

TABLE 2-continued

| Starting nucleotide of target sequence in SEQ ID NO: 6 | Sequence (5'-3') | Sequence (5'-3') with modifications |
|---|---|---|
| 1417 | AGACAGAAGCAGCA (SEQ ID NO: 395) | lAslGslAsmdCsdAsdGsdAsdAsdGsmdCsdAslGslCslA (SEQ ID NO: 396) |
| 1418 | TAGACAGAAGCAGC (SEQ ID NO: 397) | lTslAslGsdAsmdCsdAsdGsdAsdAsdGsmdCslAslGslC (SEQ ID NO: 398) |
| 1419 | ATAGACAGAAGCAG (SEQ ID NO: 399) | lAslTslAsdGsdAsmdCsdAsdGsdAsdAsdGslCslAslG (SEQ ID NO: 400) |
| 1420 | CATAGACAGAAGCA (SEQ ID NO: 401) | lCslAslTsdAsdGsdAsmdCsdAsdGsdAsdAslGslCslA (SEQ ID NO: 402) |
| 1421 | TCATAGACAGAAGC (SEQ ID NO: 403) | lTslCslAsdTsdAsdGsdAsmdCsdAsdGsdAslAslGslC (SEQ ID NO: 404) |
| 1422 | TTCATAGACAGAAG (SEQ ID NO: 405) | lTslTslCsdAsdTsdAsdGsdAsmdCsdAsdGslAslAslG (SEQ ID NO: 406) |
| 1423 | GTTCATAGACAGAA (SEQ ID NO: 407) | lGslTslTsmdCsdAsdTsdAsdGsdAsmdCsdAslGslAslA (SEQ ID NO: 408) |
| 1424 | GGTTCATAGACAGA (SEQ ID NO: 409) | lGslGslTsdTsmdCsdAsdTsdAsdGsdAsmdCslAslGslA (SEQ ID NO: 410) |
| 1425 | GGGTTCATAGACAG (SEQ ID NO: 411) | lGslGslGsdTsdTsmdCsdAsdTsdAsdGsdAslCslAslG (SEQ ID NO: 412) |
| 1484 | CCCCATCATTCATG (SEQ ID NO: 413) | lCslCslCsmdCsdAsdTsmdCsdAsdTsdTsmdCslAslTslG (SEQ ID NO: 414) |
| 1557 | TTATAGCAGGCACA (SEQ ID NO: 415) | lTslTslAsdTsdAsdGsmdCsdAsdGsdGsmdCslAslCslA (SEQ ID NO: 416) |
| 1558 | CTTATAGCAGGCAC (SEQ ID NO: 417) | lCslTslTsdAsdTsdAsdGsmdCsdAsdGsdGslCslAslC (SEQ ID NO: 418) |
| 1559 | TCTTATAGCAGGCA (SEQ ID NO: 419) | lTslCslTsdTsdAsdTsdAsdGsmdCsdAsdGslGslCslA (SEQ ID NO: 420) |
| 1561 | GATCTTATAGCAGG (SEQ ID NO: 421) | lGslAslTsmdCsdTsdTsdAsdTsdAsdGsmdCslAslGslG (SEQ ID NO: 422) |
| 1582 | AAAGTGCAGGAGGG (SEQ ID NO: 423) | lAslAslAsdGsdTsdGsmdCsdAsdGsdGsdAslGslGslG (SEQ ID NO: 424) |
| 1587 | TTGCCAAAGTGCAG (SEQ ID NO: 425) | lTslTslGsmdCsmdCsdAsdAsdAsdGsdTsdGslCslAslG (SEQ ID NO: 426) |
| 1703 | AAAGGCCTTTGAGG (SEQ ID NO: 427) | lAslAslAsdGsdGsmdCsmdCsdTsdTsdTsdGslAslGslG (SEQ ID NO: 428) |
| 1704 | AAAAGGCCTTTGAG (SEQ ID NO: 429) | lAslAslAsdAsdGsdGsmdCsmdCsdTsdTsdTslGslAslG (SEQ ID NO: 430) |
| 1705 | CAAAAGGCCTTTGA (SEQ ID NO: 431) | lCslAslAsdAsdAsdGsdGsmdCsmdCsdTsdTslTslGslA (SEQ ID NO: 432) |
| 1706 | GCAAAAGGCCTTTG (SEQ ID NO: 433) | lGslCslAsdAsdAsdAsdGsdGsmdCsmdCsdTslTslTslG (SEQ ID NO: 434) |
| 1707 | TGCAAAAGGCCTTT (SEQ ID NO: 435) | lTslGslCsdAsdAsdAsdAsdGsdGsmdCsmdCslTslTslT (SEQ ID NO: 436) |
| 1708 | GTGCAAAAGGCCTT (SEQ ID NO: 437) | lGslTslGsmdCsdAsdAsdAsdAsdGsdGsmdCslCslTslT (SEQ ID NO: 438) |
| 1709 | GGTGCAAAAGGCCT (SEQ ID NO: 439) | lGslGslTsdGsmdCsdAsdAsdAsdAsdGsdGslCslCslT (SEQ ID NO: 440) |
| 1710 | GGGTGCAAAAGGCC (SEQ ID NO: 441) | lGslGslGsdTsdGsmdCsdAsdAsdAsdAsdGslGslCslC (SEQ ID NO: 442) |

TABLE 2-continued

| Starting nucleotide of target sequence in SEQ ID NO: 6 | Sequence (5'-3') | Sequence (5'-3') with modifications |
|---|---|---|
| 1804 | GTCATAGGTGGCCT (SEQ ID NO: 443) | lGslTslCsdAsdTsdAsdGsdGsdTsdGsdGslCslCslT (SEQ ID NO: 444) |
| 1805 | GGTCATAGGTGGCC (SEQ ID NO: 445) | lGslGslTsmdCsdAsdTsdAsdGsdGsdTsdGslGslCslC (SEQ ID NO: 446) |
| 1819 | CCACCTGAACAGCC (SEQ ID NO: 447) | lCslCslAsmdCsmdCsdTsdGsdAsdAsmdCsdAslGslCslC (SEQ ID NO: 448) |
| 1820 | GCCACCTGAACAGC (SEQ ID NO: 449) | lGslCslCsdAsmdCsmdCsdTsdGsdAsdAsmdCslAslGslC (SEQ ID NO: 450) |
| 1827 | GACACCAGCCACCT (SEQ ID NO: 451) | lGslAslCsdAsmdCsmdCsdAsdGsmdCsmdCsdAslCslCslT (SEQ ID NO: 452) |
| 1850 | TGTCCAGGGTCTGG (SEQ ID NO: 453) | lTslGslTsmdCsmdCsdAsdGsdGsdGsdTsmdCslTslGslG (SEQ ID NO: 454) |
| 1851 | GTGTCCAGGGTCTG (SEQ ID NO: 455) | lGslTslGsdTsmdCsmdCsdAsdGsdGsdGsdTslCslTslG (SEQ ID NO: 456) |
| 1852 | TGTGTCCAGGGTCT (SEQ ID NO: 457) | lTslGslTsdGsdTsmdCsmdCsdAsdGsdGsdGslTslCslT (SEQ ID NO: 458) |
| 2189 | TGGGTGACTTCCCC (SEQ ID NO: 459) | lTslGslGsdGsdTsdGsdAsmdCsdTsdTsmdCslCslCslC (SEQ ID NO: 460) |
| 2190 | TTGGGTGACTTCCC (SEQ ID NO: 461) | lTslTslGsdGsdGsdTsdGsdAsmdCsdTsdTslCslCslC (SEQ ID NO: 462) |
| 2191 | ATTGGGTGACTTCC (SEQ ID NO: 463) | lAslTslTsdGsdGsdGsdTsdGsdAsmdCsdTslTslCslC (SEQ ID NO: 464) |
| 2198 | GCTGGAAATTGGGT (SEQ ID NO: 465) | lGslCslTsdGsdGsdAsdAsdAsdTsdTsdGslGslGslT (SEQ ID NO: 466) |
| 2274 | CTGTAAGGCACCAC (SEQ ID NO: 467) | lCslTslGsdTsdAsdAsdGsdGsmdCsdAsmdCslCslAslC (SEQ ID NO: 468) |
| 2275 | GCTGTAAGGCACCA (SEQ ID NO: 469) | lGslCslTsdGsdTsdAsdAsdGsdGsmdCsdAslCslCslA (SEQ ID NO: 470) |
| 2276 | TGCTGTAAGGCACC (SEQ ID NO: 471) | lTslGslCsdTsdGsdTsdAsdAsdGsdGsmdCslAslCslC (SEQ ID NO: 472) |
| 2350 | ATTCTGTGACTTCT (SEQ ID NO: 473) | lAslTslTsmdCsdTsdGsdTsdGsdAsmdCsdTslTslCslT (SEQ ID NO: 474) |
| 2351 | TATTCTGTGACTTC (SEQ ID NO: 475) | lTslAslTsdTsmdCsdTsdGsdTsdGsdAsmdCslTslTslC (SEQ ID NO: 476) |
| 2352 | CTATTCTGTGACTT (SEQ ID NO: 477) | lCslTslAsdTsdTsmdCsdTsdGsdTsdGsdAslCslTslT (SEQ ID NO: 478) |
| 2353 | CCTATTCTGTGACT (SEQ ID NO: 479) | lCslCslTsdAsdTsdTsmdCsdTsdGsdTsdGslAslCslT (SEQ ID NO: 480) |
| 2354 | GCCTATTCTGTGAC (SEQ ID NO: 481) | lGslCslCsdTsdAsdTsdTsmdCsdTsdGsdTslGslAslC (SEQ ID NO: 482) |
| 2355 | AGCCTATTCTGTGA (SEQ ID NO: 483) | lAslGslCsmdCsdTsdAsdTsdTsmdCsdTsdGslTslGslA (SEQ ID NO: 484) |
| 2356 | GAGCCTATTCTGTG (SEQ ID NO: 485) | lGslAslGsmdCsmdCsdTsdAsdTsdTsmdCsdTslGslTslG (SEQ ID NO: 486) |
| 2357 | GGAGCCTATTCTGT (SEQ ID NO: 487) | lGslGslAsdGsmdCsmdCsdTsdAsdTsdTsmdCslTslGslT (SEQ ID NO: 488) |
| 2358 | AGGAGCCTATTCTG (SEQ ID NO: 489) | lAslGslGsdAsdGsmdCsmdCsdTsdAsdTsdTslCslTslG (SEQ ID NO: 490) |

TABLE 2-continued

| Starting nucleotide of target sequence in SEQ ID NO: 6 | Sequence (5'-3') | Sequence (5'-3') with modifications |
|---|---|---|
| 2359 | CAGGAGCCTATTCT (SEQ ID NO: 491) | lCslAslGsdGsdAsdGsmdCsmdCsdTsdAsdTslTslCslT (SEQ ID NO: 492) |
| 2360 | CCAGGAGCCTATTC (SEQ ID NO: 493) | lCslCslAsdGsdGsdAsdGsmdCsmdCsdTsdAslTslTslC (SEQ ID NO: 494) |
| 2361 | GCCAGGAGCCTATT (SEQ ID NO: 495) | lGslCslCsdAsdGsdGsdAsdGsmdCsmdCsdTslAslTslT (SEQ ID NO: 496) |
| 2375 | TCTCATAGAGAGTC (SEQ ID NO: 497) | lTslCslTsmdCsdAsdTsdAsdGsdAsdGsdAslGslTslC (SEQ ID NO: 498) |
| 2376 | TTCTCATAGAGAGT (SEQ ID NO: 499) | lTslTslCsdTsmdCsdAsdTsdAsdGsdAsdGslAslGslT (SEQ ID NO: 500) |
| 2396 | TGGAGCAGGAGCCC (SEQ ID NO: 501) | lTslGslGsdAsdGsmdCsdAsdGsdGsdAsdGslCslCslC (SEQ ID NO: 502) |
| 2397 | GTGGAGCAGGAGCC (SEQ ID NO: 503) | lGslTslGsdGsdAsdGsmdCsdAsdGsdGsdAslGslCslC (SEQ ID NO: 504) |
| 2443 | TGCTGCCTTCTTAC (SEQ ID NO: 505) | lTslGslCsdTsdGsmdCsmdCsdTsdTsmdCsdTslTslAslC (SEQ ID NO: 506) |
| 2444 | ATGCTGCCTTCTTA (SEQ ID NO: 507) | lAslTslGsmdCsdTsdGsmdCsmdCsdTsdTsmdCslTslTslA (SEQ ID NO: 508) |
| 2445 | GATGCTGCCTTCTT (SEQ ID NO: 509) | lGslAslTsdGsmdCsdTsdGsmdCsmdCsdTsdTslCslTslT (SEQ ID NO: 510) |
| 2579 | AGAAGGCATCCATG (SEQ ID NO: 511) | lAslGslAsdAsdGsdGsmdCsdAsdTsmdCsmdCslAslTslG (SEQ ID NO: 512) |
| 2580 | AAGAAGGCATCCAT (SEQ ID NO: 513) | lAslAslGsdAsdAsdGsdGsmdCsdAsdTsmdCslCslAslT (SEQ ID NO: 514) |
| 2581 | CAAGAAGGCATCCA (SEQ ID NO: 515) | lCslAslAsdGsdAsdAsdGsdGsmdCsdAsdTslCslCslA (SEQ ID NO: 516) |
| 2584 | CACCAAGAAGGCAT (SEQ ID NO: 517) | lCslAslCsmdCsdAsdAsdGsdAsdAsdGsdGslCslAslT (SEQ ID NO: 518) |
| 2585 | GCACCAAGAAGGCA (SEQ ID NO: 519) | lGslCslAsmdCsmdCsdAsdAsdGsdAsdAsdGslGslCslA (SEQ ID NO: 520) |
| 2587 | TAGCACCAAGAAGG (SEQ ID NO: 521) | lTslAslGsmdCsdAsmdCsmdCsdAsdAsdGsdAslAslGslG (SEQ ID NO: 522) |
| 2588 | GTAGCACCAAGAAG (SEQ ID NO: 523) | lGslTslAsdGsmdCsdAsmdCsmdCsdAsdAsdGslAslAslG (SEQ ID NO: 524) |
| 2589 | TGTAGCACCAAGAA (SEQ ID NO: 525) | lTslGslTsdAsdGsmdCsdAsmdCsmdCsdAsdAslGslAslA (SEQ ID NO: 526) |
| 2590 | GTGTAGCACCAAGA (SEQ ID NO: 527) | lGslTslGsdTsdAsdGsmdCsdAsmdCsmdCsdAslAslGslA (SEQ ID NO: 528) |
| 2591 | GGTGTAGCACCAAG (SEQ ID NO: 529) | lGslGslTsdGsdTsdAsdGsmdCsdAsmdCsmdCslAslAslG (SEQ ID NO: 530) |
| 2592 | TGGTGTAGCACCAA (SEQ ID NO: 531) | lTslGslGsdTsdGsdTsdAsdGsmdCsdAsmdCslCslAslA (SEQ ID NO: 532) |
| 2709 | GGGATGGCACTGGG (SEQ ID NO: 533) | lGslGslGsdAsdTsdGsdGsmdCsdAsmdCsdTslGslGslG (SEQ ID NO: 534) |
| 2731 | GCTGTCCATGAAGG (SEQ ID NO: 535) | lGslCslTsdGsdTsmdCsmdCsdAsdTsdGsdAslAslGslG (SEQ ID NO: 536) |
| 2830 | GCCTAGAAGCCCAG (SEQ ID NO: 537) | lGslCslCsdTsdAsdGsdAsdAsdGsmdCsmdCslCslAslG (SEQ ID NO: 538) |

TABLE 2-continued

| Starting nucleotide of target sequence in SEQ ID NO: 6 | Sequence (5'-3') | Sequence (5'-3') with modifications |
|---|---|---|
| 2986 | GGCATTGAAGGCAC (SEQ ID NO: 539) | lGslGslCsdAsdTsdTsdGsdAsdAsdGsdGslCslAslC (SEQ ID NO: 540) |
| 3248 | ACTTGATCAGCAAG (SEQ ID NO: 541) | lAslCslTsdTsdGsdAsdTsmdCsdAsdGsmdCslAslAslG (SEQ ID NO: 542) |
| 3249 | GACTTGATCAGCAA (SEQ ID NO: 543) | lGslAslCsdTsdTsdGsdAsdTsmdCsdAsdGslCslAslA (SEQ ID NO: 544) |
| 3625 | GCATTCCAGGTCCT (SEQ ID NO: 545) | lGslCslAsdTsdTsmdCsmdCsdAsdGsdGsdTslCslCslT (SEQ ID NO: 546) |
| 3626 | AGCATTCCAGGTCC (SEQ ID NO: 547) | lAslGslCsdAsdTsdTsmdCsmdCsdAsdGsdGslTslCslC (SEQ ID NO: 548) |
| 3628 | GGAGCATTCCAGGT (SEQ ID NO: 549) | lGslGslAsdGsmdCsdAsdTsdTsmdCsmdCsdAslGslGslT (SEQ ID NO: 550) |
| 3629 | GGGAGCATTCCAGG (SEQ ID NO: 551) | lGslGslGsdAsdGsmdCsdAsdTsdTsmdCsmdCslAslGslG (SEQ ID NO: 552) |
| 3631 | CAGGGAGCATTCCA (SEQ ID NO: 553) | lCslAslGsdGsdGsdAsdGsmdCsdAsdTsdTslCslCslA (SEQ ID NO: 554) |
| 3793 | CAGGCTCAGCTGGC (SEQ ID NO: 555) | lCslAslGsdGsmdCsdTsmdCsdAsdGsmdCsdTslGslGslC (SEQ ID NO: 556) |
| 3794 | GCAGGCTCAGCTGG (SEQ ID NO: 557) | lGslCslAsdGsdGsmdCsdTsmdCsdAsdGsmdCslTslGslG (SEQ ID NO: 558) |
| 4233 | GTCAGAGTCTCCAC (SEQ ID NO: 559) | lGslTslCsdAsdGsdAsdGsdTsmdCsdTsmdCslCslAslC (SEQ ID NO: 560) |
| 4234 | GGTCAGAGTCTCCA (SEQ ID NO: 561) | lGslGslTsmdCsdAsdGsdAsdGsdTsmdCsdTslCslCslA (SEQ ID NO: 562) |
| 4235 | GGGTCAGAGTCTCC (SEQ ID NO: 563) | lGslGslGsdTsmdCsdAsdGsdAsdGsdTsmdCslTslCslC (SEQ ID NO: 564) |
| 4286 | TTAGCTGATCCTCA (SEQ ID NO: 565) | lTslTslAsdGsmdCsdTsdGsdAsdTsmdCsmdCslTslCslA (SEQ ID NO: 566) |
| 4287 | CTTAGCTGATCCTC (SEQ ID NO: 567) | lCslTslTsdAsdGsmdCsdTsdGsdAsdTsmdCslCslTslC (SEQ ID NO: 568) |
| 4410 | ATCAGACACTCCTT (SEQ ID NO: 569) | lAslTslCsdAsdGsdAsmdCsdAsmdCsdTsmdCslCslTslT (SEQ ID NO: 570) |
| 4412 | TGATCAGACACTCC (SEQ ID NO: 571) | lTslGslAsdTsmdCsdAsdGsdAsmdCsdAsmdCslTslCslC (SEQ ID NO: 572) |
| 4413 | CTGATCAGACACTC (SEQ ID NO: 573) | lCslTslGsdAsdTsmdCsdAsdGsdAsmdCsdAslCslTslC (SEQ ID NO: 574) |
| 4414 | ACTGATCAGACACT (SEQ ID NO: 575) | lAslCslTsdGsdAsdTsmdCsdAsdGsdAsmdCslAslCslT (SEQ ID NO: 576) |
| 4415 | GACTGATCAGACAC (SEQ ID NO: 577) | lGslAslCsdTsdGsdAsdTsmdCsdAsdGsdAslCslAslC (SEQ ID NO: 578) |
| 4416 | TGACTGATCAGACA (SEQ ID NO: 579) | lTslGslAsmdCsdTsdGsdAsdTsmdCsdAsdGslAslCslA (SEQ ID NO: 580) |
| 4417 | CTGACTGATCAGAC (SEQ ID NO: 581) | lCslTslGsdAsmdCsdTsdGsdAsdTsmdCsdAslGslAslC (SEQ ID NO: 582) |
| 4418 | GCTGACTGATCAGA (SEQ ID NO: 583) | lGslCslTsdGsdAsmdCsdTsdGsdAsdTsmdCslAslGslA (SEQ ID NO: 584) |
| 4419 | AGCTGACTGATCAG (SEQ ID NO: 585) | lAslGslCsdTsdGsdAsmdCsdTsdGsdAsdTslCslAslG (SEQ ID NO: 586) |

TABLE 2-continued

| Starting nucleotide of target sequence in SEQ ID NO: 6 | Sequence (5'-3') | Sequence (5'-3') with modifications |
|---|---|---|
| 4422 | CTCAGCTGACTGAT (SEQ ID NO: 587) | lCslTslCsdAsdGsmdCsdTsdGsdAsmdCsdTslGslAslT (SEQ ID NO: 588) |
| 4423 | GCTCAGCTGACTGA (SEQ ID NO: 589) | lGslCslTsmdCsdAsdGsmdCsdTsdGsdAsmdCslTslGslA (SEQ ID NO: 590) |
| 4424 | GGCTCAGCTGACTG (SEQ ID NO: 591) | lGslGslCsdTsmdCsdAsdGsmdCsdTsdGsdAslCslTslG (SEQ ID NO: 592) |
| 4797 | TCCTCTGACTCTGT (SEQ ID NO: 593) | lTslCslCsdTsmdCsdTsdGsdAsmdCsdTsmdCslTslGslT (SEQ ID NO: 594) |
| 4798 | ATCCTCTGACTCTG (SEQ ID NO: 595) | lAslTslCsmdCsdTsmdCsdTsdGsdAsmdCslTslCslTslG (SEQ ID NO: 596) |
| 4799 | CATCCTCTGACTCT (SEQ ID NO: 597) | lCslAslTsmdCsmdCsdTsmdCsdTsdGsdAsmdCslTslCslT (SEQ ID NO: 598) |
| 4800 | ACATCCTCTGACTC (SEQ ID NO: 599) | lAslCslAsdTsmdCsmdCsdTsmdCsdTsdGsdAslCslTslC (SEQ ID NO: 600) |
| 4801 | TACATCCTCTGACT (SEQ ID NO: 601) | lTslAslCsdAsdTsmdCsmdCsdTsmdCsdTsdGslAslCslT (SEQ ID NO: 602) |
| 4802 | TTACATCCTCTGAC (SEQ ID NO: 603) | lTslTslAsmdCsdAsdTsmdCsmdCsdTsmdCsdTslGslAslC (SEQ ID NO: 604) |
| 4803 | GTTACATCCTCTGA (SEQ ID NO: 605) | lGslTslTsdAsmdCsdAsdTsmdCsmdCsdTsmdCslTslGslA (SEQ ID NO: 606) |
| 4804 | GGTTACATCCTCTG (SEQ ID NO: 607) | lGslGslTsdTsdAsmdCsdAsdTsmdCsmdCslTslCslTslG (SEQ ID NO: 608) |
| 4805 | GGGTTACATCCTCT (SEQ ID NO: 609) | lGslGslGsdTsdTsdAsmdCsdAsdTsmdCsmdCslTslCslT (SEQ ID NO: 610) |
| 4806 | AGGGTTACATCCTC (SEQ ID NO: 611) | lAslGslGsdGsdTsdTsdAsmdCsdAsdTsmdCslCslTslC (SEQ ID NO: 612) |
| 4807 | CAGGGTTACATCCT (SEQ ID NO: 613) | lCslAslGsdGsdGsdTsdTsdAsmdCsdAsdTslCslCslT (SEQ ID NO: 614) |
| 4808 | CCAGGGTTACATCC (SEQ ID NO: 615) | lCslCslAsdGsdGsdGsdTsdTsdAsmdCsdAslTslCslC (SEQ ID NO: 616) |
| 4811 | GCTCCAGGGTTACA (SEQ ID NO: 617) | lGslCslTsmdCsmdCsdAsdGsdGsdGsdTsdTslAslCslA (SEQ ID NO: 618) |
| 4812 | AGCTCCAGGGTTAC (SEQ ID NO: 619) | lAslGslCsdTsmdCsmdCsdAsdGsdGsdGsdTslTslAslC (SEQ ID NO: 620) |
| 4836 | GCAGCTGCTGAGGT (SEQ ID NO: 621) | lGslCslAsdGsmdCsdTsdGsmdCsdTsdGsdAslGslGslT (SEQ ID NO: 622) |
| 4837 | AGCAGCTGCTGAGG (SEQ ID NO: 623) | lAslGslCsdAsdGsmdCsdTsdGsmdCsdTsdGslAslGslG (SEQ ID NO: 624) |
| 6033 | CCCTTAAGGGCCTC (SEQ ID NO: 625) | lCslCslCsdTsdTsdAsdAsdGsdGsdGsmdCslCslTslC (SEQ ID NO: 626) | l = locked nucleotide;
d = deoxynucleotide;
mdC = 5-Methyl cytosine;
m = 2'-O-methyl nucleotide;
s = phosphorothioate linkage

TABLE 3

| Starting nucleotide of target sequence in SEQ ID NO: 6 | Sequence (5'-3') | Sequence (5'-3') with modifications |
|---|---|---|
| 436 | AGGCAGCAGGCACT (SEQ ID NO: 627) | lAsdGslGsdCslAslGsdCsdAslGsdGslCsdAslCslT (SEQ ID NO: 628) |
| 513 | TCACTCACATCCAT (SEQ ID NO: 629) | lTsdCslAsdCslTslCsdAsdCslAsdTslCsdCslAslT (SEQ ID NO: 630) |
| 524 | ACTCCCCAAGTTCA (SEQ ID NO: 631) | lAsdCslTsdCslCslCsdCsdAslAsdGslTsdTslCslA (SEQ ID NO: 632) |
| 610 | AGGCACCCAGACTC (SEQ ID NO: 633) | lAsdGslGsdCslAslCsdCsdCslAsdGslAsdCslTslC (SEQ ID NO: 634) |
| 735 | GGGTTCATGGGCTG (SEQ ID NO: 635) | lGsdGslGsdTslTslCsdAsdTslGsdGslGsdCslTslG (SEQ ID NO: 636) |
| 867 | ATGGTGACACAGAA (SEQ ID NO: 637) | lAsdTslGsdGslTslGsdAsdCslAsdCslAsdGslAslA (SEQ ID NO: 638) |
| 1020 | ATCAGCATGGACTG (SEQ ID NO: 639) | lAsdTslCsdAslGslCsdAsdTslGsdGslAsdCslTslG (SEQ ID NO: 640) |
| 1061 | GCTTGGTGTTAACC (SEQ ID NO: 641) | lGsdCslTsdTslGslGsdTsdGslTsdTslAsdAslCslC (SEQ ID NO: 642) |
| 1188 | TCCATGGCAGGGTT (SEQ ID NO: 643) | lTsdCslCsdAslTslGsdGsdCslAsdGslGsdGslTslT (SEQ ID NO: 644) |
| 1305 | AGATAGCTGTCAAT (SEQ ID NO: 645) | lAsdGslAsdTslAslGsdCsdTslGsdTslCsdAslAslT (SEQ ID NO: 646) |
| 1443 | CAGAAGTGGTAGTC (SEQ ID NO: 647) | lCsdAslGsdAslAslGsdTsdGslGsdTslAsdGslTslC (SEQ ID NO: 648) |
| 1447 | GCTGCAGAAGTGGT (SEQ ID NO: 649) | lGsdCslTsdGslCslAsdGsdAslAsdGslTsdGslGslT (SEQ ID NO: 650) |
| 1518 | ATGTCCATGGCATG (SEQ ID NO: 651) | lAsdTslGsdTslCslCsdAsdTslGsdGslCsdAslTslG (SEQ ID NO: 652) |
| 1560 | ATCTTATAGCAGGC (SEQ ID NO: 653) | lAsdTslCsdTslTslAsdTsdAslGsdCslAsdGslGslC (SEQ ID NO: 654) |
| 1647 | GCACTCTCAGTGCC (SEQ ID NO: 655) | lGsdCslAsdCslTslCsdTsdCslAsdGslTsdGslCslC (SEQ ID NO: 656) |
| 1662 | TAGGCAGCCTTGTC (SEQ ID NO: 657) | lTsdAslGsdGslCslAsdGsdCslCsdTslTsdGslTslC (SEQ ID NO: 658) |
| 1694 | TGAGGAGGTCCCCA (SEQ ID NO: 659) | lTsdGslAsdGslGslAsdGsdGslTsdCslCsdCslCslA (SEQ ID NO: 660) |
| 1755 | ACACTCTGGCCCTT (SEQ ID NO: 661) | lAsdCslAsdCslTslCsdTsdGslGsdCslCsdCslTslT (SEQ ID NO: 662) |
| 1764 | ACCTGCTCCACACT (SEQ ID NO: 663) | lAsdCslCsdTslGslCsdTsdCslCsdAslCsdAslCslT (SEQ ID NO: 664) |
| 1828 | AGACACCAGCCACC (SEQ ID NO: 665) | lAsdGslAsdCslAslCsdCsdAslGsdCslCsdAslCslC (SEQ ID NO: 666) |
| 1912 | CTCAAAGATCTCAA (SEQ ID NO: 667) | lCsdTslCsdAslAslAsdGsdAslTsdCslTsdCslAslA (SEQ ID NO: 668) |
| 2037 | ATGAAGACCCAGTC (SEQ ID NO: 669) | lAsdTslGsdAslAslGsdAsdCslCsdCslAsdGslTslC (SEQ ID NO: 670) |
| 2218 | CTTCTTGTCAGGCC (SEQ ID NO: 671) | lCsdTslTsdCslTslTsdGsdTslCsdAslGsdGslCslC (SEQ ID NO: 672) |
| 2253 | TAGTGGACCACCTC (SEQ ID NO: 673) | lTsdAslGsdTslGslGsdAsdCslCsdAslCsdCslTslC (SEQ ID NO: 674) |

TABLE 3-continued

| Starting nucleotide of target sequence in SEQ ID NO: 6 | Sequence (5'-3') | Sequence (5'-3') with modifications |
|---|---|---|
| 2481 | AGGTTCTCCTTGTG (SEQ ID NO: 675) | lAsdGslGsdTslTslCsdTsdCslCsdTslTsdGslTslG (SEQ ID NO: 676) |
| 2518 | GGGCTGTGTGGCCC (SEQ ID NO: 677) | lGsdGslGsdCslTslGsdTsdGslTsdGslGsdCslCslC (SEQ ID NO: 678) |
| 2738 | CCTTCCTGCTGTCC (SEQ ID NO: 679) | lCsdCslTsdTslCslCsdTsdGslCsdTslGsdTslCslC (SEQ ID NO: 680) |
| 2961 | TGGATGGTGAACAG (SEQ ID NO: 681) | lTsdGslGsdAslTslGsdGsdTslGsdAslAsdCslAslG (SEQ ID NO: 682) |
| 3186 | TGCAGGGCCAGGTC (SEQ ID NO: 683) | lTsdGslCsdAslGslGsdGsdCslCsdAslGsdGslTslC (SEQ ID NO: 684) |
| 3255 | ACCTTGGACTTGAT (SEQ ID NO: 685) | lAsdCslCsdTslTslGsdGsdAslCsdTslTsdGslAslT (SEQ ID NO: 686) |
| 3625 | GCATTCCAGGTCCT (SEQ ID NO: 687) | lGsdCslAsdTslTslCsdCsdAslGsdGslTsdCslCslT (SEQ ID NO: 688) |
| 3794 | GCAGGCTCAGCTGG (SEQ ID NO: 689) | lGsdCslAsdGslGslCsdTsdCslAsdGslCsdTslGslG (SEQ ID NO: 690) |
| 4253 | CTGCACTGGCCTTG (SEQ ID NO: 691) | lCsdTslGsdCslAslCsdTsdGslGsdCslCsdTslTslG (SEQ ID NO: 692) |
| 4259 | GCTTCTCTGCACTG (SEQ ID NO: 693) | lGsdCslTsdTslCslTsdCsdTslGsdCslAsdCslTslG (SEQ ID NO: 694) |
| 4302 | TTGATCTTGGCCTC (SEQ ID NO: 695) | lTsdTslGsdAslTslCsdTsdTslGsdGslCsdCslTslC (SEQ ID NO: 696) |
| 4318 | CTGCAGCTCCTCCA (SEQ ID NO: 697) | lCsdTslGsdCslAslGsdCsdTslCsdCslTsdCslCslA (SEQ ID NO: 698) |
| 4416 | TGACTGATCAGACA (SEQ ID NO: 699) | lTsdGslAsdCslTslGsdAsdTslCsdAslGsdAslCslA (SEQ ID NO: 700) |
| 4656 | ATGGCATCTGCTTC (SEQ ID NO: 701) | lAsdTslGsdGslCslAsdTsdCslTsdGslCsdTslTslC (SEQ ID NO: 702) |
| 4717 | TGCCTCCTGCAGCC (SEQ ID NO: 703) | lTsdGslCsdCslTslCsdCsdTslGslCslAsdGslCslC (SEQ ID NO: 704) |
| 4773 | AGCTTGGCCTTCTC (SEQ ID NO: 705) | lAsdGslCsdTslTslGsdGsdCslCsdTslTsdCslTslC (SEQ ID NO: 706) |
| 4802 | TTACATCCTCTGAC (SEQ ID NO: 707) | lTsdTslAsdCslAslTsdCsdCslTsdCslTsdGslAslC (SEQ ID NO: 708) |
| 4837 | AGCAGCTGCTGAGG (SEQ ID NO: 709) | lAsdGslCsdAslGslCsdTsdGslCsdTslGsdAslGslG (SEQ ID NO: 710) |
| 4904 | TCTCCTCCTCCTGC (SEQ ID NO: 711) | lTsdCslTsdCslTslCsdCsdTslCsdCslTsdCslGslC (SEQ ID NO: 712) |
| 6033 | CCCTTAAGGGCCTC (SEQ ID NO: 713) | lCsdCslCsdTslTslAsdAsdGslGsdGslCsdCslTslC (SEQ ID NO: 714) |
| 6099 | AGGTTCTTCCTGTC (SEQ ID NO: 715) | lAsdGslGsdTslTslCsdTsdTslCsdCslTsdGslTslC (SEQ ID NO: 716) |
| 6142 | GACCTTGCTCTGCA (SEQ ID NO: 717) | lGsdAslCsdCslTslTsdGsdCslTsdCslTsdGslCslA (SEQ ID NO: 718) |
| 6149 | AGCTCTTGACCTTG (SEQ ID NO: 719) | lAsdGslCsdTslCslTsdTsdGslAsdCslCsdTslTslG (SEQ ID NO: 720) |

TABLE 3-continued

| Starting nucleotide of target sequence in SEQ ID NO: 6 | Sequence (5'-3') | Sequence (5'-3') with modifications |
|---|---|---|
| 6220 | GTGCTGGGCCTTGC (SEQ ID NO: 721) | lGsdTslGsdCslTslGsdGsdGslCsdCslTsdTslGslC (SEQ ID NO: 722) |
| 6273 | TTGTTGGCCTGGGT (SEQ ID NO: 723) | lTsdTslGsdTslTslGsdGsdCslCsdTslGsdGslGslT (SEQ ID NO: 724) |
| 6277 | CAGCTTGTTGGCCT (SEQ ID NO: 725) | lCsdAslGsdCslTslTsdGsdTslTsdGslGsdCslCslT (SEQ ID NO: 726) |

TABLE 4

| Starting nucleotide of target sequence in SEQ ID NO: 6 | Sequence (5'-3') | Sequence (5'-3') with modifications |
|---|---|---|
| 4302 | +TT+GA+T+CTT+GG+CC+T+C (SEQ ID NO: 727) | lTsdTslGsdAsLTslCsdTsdTslGsdGslCsdCslTslC (SEQ ID NO: 728) |
| 4302 | +TT+GA+TC+T+T+GGC+CT+C (SEQ ID NO: 729) | lTsdTsLGsdAslTsdCslTslTslGsdGsdCslCsdTslC (SEQ ID NO: 730) |
| 4302 |  | lTslTslGsdAsdTsmdCsdTsdTsdGsdGsmdCslCslTslC (SEQ ID NO: 731) |
| 4302 | TTGATCTTGGCCTC (SEQ ID NO: 732) | eTseTseGsdAsdTsmdCsdTsdTsdGsdGsmdCseCseTseC (SEQ ID NO: 733) |
| 4302 | TTGATCTTGGCCTC (SEQ ID NO: 734) | lTslTsmGsdAsdTsmdCsdTsdTsdGsdGsmdCsmCslTslC (SEQ ID NO: 735) |
| 4302 | TTGATCTTGGCCTC (SEQ ID NO: 736) | eTseTslGsdAsdTsmdCsdTsdTsdGsdGsmdCseCseTseC (SEQ ID NO: 737) |
| 4302 | TTGATCTTGGCCTC (SEQ ID NO: 738) | eTslTslGsdAsdTsmdCsdTsdTsdGsdGsmdCslCslTslC (SEQ ID NO: 739) |
| 4302 | TTGATCTTGGCCTC (SEQ ID NO: 740) | lTseTslGsdAsdTsmdCsdTsdTsdGsdGsmdCslCslTslC (SEQ ID NO: 741) |
| 4302 | TTGATCTTGGCCTC (SEQ ID NO: 742) | lTslTseGsdAsdTsmdCsdTsdTsdGsdGsmdCslCslTslC (SEQ ID NO: 743) |
| 4302 | TTGATCTTGGCCTC (SEQ ID NO: 744) | lTslTslGsdAsdTsmdCsdTsdTsdGsdGsmdCseCslTslC (SEQ ID NO: 745) |
| 4302 | TTGATCTTGGCCTC (SEQ ID NO: 746) | lTslTslGsdAsdTsmdCsdTsdTsdGsdGsmdCslCseTslC (SEQ ID NO: 747) |
| 4302 | TTGATCTTGGCCTC (SEQ ID NO: 748) | lTslTslGsdAsdTsmdCsdTsdTsdGsdGsmdCslCslTseC (SEQ ID NO: 749) |
| 4302 | TTGATCTTGGCCTC (SEQ ID NO: 750) | lTslTslGdAdTmdCdTdTdGdGmdClCslTslC (SEQ ID NO: 751) |
| 4302 | TTGATCTTGGCCTC (SEQ ID NO: 752) | lTslTslGsdAdTmdCdTdTdGdGmdCslCslTslC (SEQ ID NO: 753) |
| 4302 | TTGATCTTGGCCTC (SEQ ID NO: 754) | lTslTslGdAsdTmdCsdTdTsdGdGsmdClCslTslC (SEQ ID NO: 755) |

TABLE 4-continued

| Starting nucleotide of target sequence in SEQ ID NO: 6 | Sequence (5'-3') | Sequence (5'-3') with modifications |
|---|---|---|
| 4302 | TTGATCTTGGCCTC (SEQ ID NO: 756) | lTslTlGsdAdTsmdCdTsdTdGsdGmdCslClTslC (SEQ ID NO: 757) |
| 4302 | TTGATCTTGGCCTC (SEQ ID NO: 758) | lTslTslGdAsdTsmdCsdTdTsdGsdGsmdClCslTsLC (SEQ ID NO: 759) |
| 4318 | CTGCAGCTCCTCCA (SEQ ID NO: 760) | lCslTsmGsmdCsdAsdGsmdCsdTsmdCsmdCsdTsmCslCslA (SEQ ID NO: 761) |
| 4318 | CTGCAGCTCCTCCA (SEQ ID NO: 762) | lCslTslGmdCsdAdGsmdCdTsmdCmdCsdTlCslCslA (SEQ ID NO: 763) |
| 4318 | CTGCAGCTCCTCCA (SEQ ID NO: 764) | lCslTslGmdCsdAsdGsmdCdTsmdCsmdCsdTlCslCslA (SEQ ID NO: 765) |
| 4302 | TTGATCTTGGCCTC (SEQ ID NO: 766) | lTsmUslGsdAsdTsmdCsdTsdTsdGsdGsmdCslCsmuslC (SEQ ID NO: 767) |
| 4302 | TTGATCTTGGCCTC (SEQ ID NO: 768) | lTslTsfGsdAsdTsmdCsdTsdTsdGsdGsmdCsfCslTslC (SEQ ID NO: 769) |
| 4661 | | lTslCsmUsdGsdGsdAsdTsdGsdGsmdCsdAsmUslCsLT (SEQ ID NO: 770) |
| 892 | | lGslAsmCsdTsdGsdGsdGsdAsdGsmdCsmdCsmAslTslT (SEQ ID NO: 771) |
| 2360 | | lCslCsmAsdGsdGsdAsdGsmdCsmdCsdTsdAsmUslTslC (SEQ ID NO: 772) |
| 1417 | | lAslGsmAsmdCsdAsdGsdAsdAsdGsmdCsdAsmGslCslA (SEQ ID NO: 773) |
| 516 | | lAslGsmUsdTsmdCsdAsmdCsdTsmdCsdAsmdCsmAslTslC (SEQ ID NO: 774) |
| 1582 | | lAslAsmAsdGsdTsdGsmdCsdAsdGsdGsdAsmGslGslG (SEQ ID NO: 775) |
| 1217 | | lTslCsmCsdTsmdCsdAsdGsdGsdGsdTsmdCsmUslTslG (SEQ ID NO: 776) |
| 515 | | lGslTsmUsmdCsdAsmdCsdTsmdCsdAsmdCsdAsmUslCslC (SEQ ID NO: 777) |
| 514 | | lTslTsmCsdAsmdCsdTsmdCsdAsmdCsdAsdTsmCslCslA (SEQ ID NO: 778) |
| 1424 | | lGslGsmUsdTsmdCsdAsdTsdAsdGsdAsmdCsmAslGslA (SEQ ID NO: 779) |
| 1219 | | lAslTsmUsmdCsmdCsdTsmdCsdAsdGsdGsdGsmUslCslT (SEQ ID NO: 780) |
| 513 | | lTslCsmAsmdCsdTsmdCsdAsmdCsdAsdTsmdCsmCslAslT (SEQ ID NO: 781) |
| 1226 | | lAslGsmUsdTsdAsdTsmdCsdAsdTsdTsmdCsmCslTslC (SEQ ID NO: 782) |
| 1225 | | lGslTsmUsdAsdTsmdCsdAsdTsdTsmdCsmdCsmUslCslA (SEQ ID NO: 783) |
| 1645 | | lAslCsmUsmdCsdTsmdCsdAsdGsdTsdGsmdCsmCslAslT (SEQ ID NO: 784) |
| 4302 | | avTsavTsavGsdAsdTsmdCsdTsdTsdGsdGsmdCsavCsavTsavC (SEQ ID NO: 785) |

TABLE 4-continued

| Starting nucleotide of target sequence in SEQ ID NO: 6 | Sequence (5'-3') | Sequence (5'-3') with modifications |
|---|---|---|
| 3257 | | avGsavCsavAsdCsdCsdTsdTsdGsdGsdAsdCsavTsavTsavG (SEQ ID NO: 786) |
| 2483 | | avTsavGsavAsdGsdGsdTsdTsdCsdTsdCsdCsavTsavTsavG (SEQ ID NO: 787) | l = locked nucleotide;
d = deoxynucleotide;
mdC = 5-Methyl cytosine;
f = 2'-fluoro nucleotide;
av = amino-CBBN nucleotide;
s = phosphorothioate linkage;
e = ethylene-bridged nucleotide

TABLE 5

| Sequence (5'-3') with modifications |
|---|
| lGslTsdGsdAsdAsdTsdGsdCsdGsdGsdAsdTslGslAslA (SEQ ID NO: 789) |
| lGslAslAsdGsdTsdGsdGsdTsdAsdGsdTsdCsdAslTslA (SEQ ID NO: 790) |
| lGsdTslGsdAsdAslTslGsdCsdGslGsdAslTsdGslAslA (SEQ ID NO: 791) |
| lGsdAslAsdGsdTslGslGsdTsdAslGsdTslCsdAslTslA (SEQ ID NO: 792) |

In one embodiment, the present invention provides methods for treating or preventing a cardiac disorder in which the expression of β-MHC is up-regulated in cardiac cells of a subject comprising administering a composition comprising an inhibitor of MYH7B to the subject. In another embodiment, the present invention provides methods for treating or preventing a cardiac disorder in which the ratio of β-MHC/α-MHC is altered in cardiac cells of a subject comprising administering a composition comprising an inhibitor of MYH7B to the subject. For instance, the present invention provides compositions and methods for treating or preventing a cardiac disorder selected from the group consisting of pathologic cardiac hypertrophy, myocardial infarction, heart failure, or hypertrophic cardiomyopathy by inhibiting the expression or activity of β-MHC and/or altering the ratio of β-MHC/α-MHC in cardiac cells of a subject using an inhibitor of MYH7B. The administration of an inhibitor of MYH7B to the subject down-regulates the expression or activity of MYH7B in cardiac cells of the subject following administration. In one embodiment, the administration of an inhibitor of MYH7B does not significantly alter the expression or activity of myomiRs, particularly, miR-499, in cardiac cells of the subject. Thus, in some embodiments, the expression of miR-499, miR-208a, and/or miR-208b in cardiac cells is not statistically different after the administration of the MYH7B inhibitor.

In various embodiments, methods provided by the invention comprise administering one or more nucleic acid inhibitors disclosed herein. For instance, in one embodiment, methods provided by the invention comprise administering an antisense oligonucleotide inhibitor selected from Tables 1-5. In another embodiment, methods according to the invention comprise administering an antisense oligonucleotide inhibitor comprising the sequence of SEQ ID NO: 146. In yet another embodiment, methods according to the invention comprise administering an antisense oligonucleotide inhibitor comprising the sequence of SEQ ID NO: 148.

In a particular embodiment, the present invention provides methods for treating or preventing hypertrophic cardiomyopathy in a subject in need thereof comprising administering a composition comprising an inhibitor of MYH7B to the subject, wherein the expression or activity of MYH7B is reduced in cardiac cells of the subject following administration of the inhibitor. In one embodiment, the administration of an inhibitor of MYH7B to the subject reduces the expression or activity of β-MHC in cardiac cells of the subject following administration.

In one embodiment, the present invention provides methods for treating or preventing pathologic cardiac hypertrophy or hypertrophic cardiomyopathy in a subject at risk of developing pathologic cardiac hypertrophy or hypertrophic cardiomyopathy. The patient at risk of developing pathologic cardiac hypertrophy or hypertrophic cardiomyopathy may exhibit one or more risk factors including, for example, long standing uncontrolled hypertension, uncorrected valvular disease, chronic angina, recent myocardial infarction, congenital predisposition to heart disease or pathological hypertrophy. In some embodiments, the subject at risk may be diagnosed as having a genetic predisposition to pathologic cardiac hypertrophy or hypertrophic cardiomyopathy. For instance, in certain embodiments, the subject at risk may carry one or more mutations in sarcomeric genes, e.g., mutations in the β-MHC (MYH7) gene. In one embodiment, the subject at risk has one or more mutations in the β-MHC (MYH7) gene selected from Arg663His, Lys207Asn, Gly256Glu, Arg403Gln, Arg453Cys, Gly584Arg, Arg719Trp, Arg723Gly, Ile736Thr, Gly741Arg, Asp778Gly, Asp778Val, Asp906Gly, and Leu908Val. In certain embodiments, the subject at risk has an Arg403Gln, Arg453Cys, or Arg719Trp mutation in the β-MHC (MYH7) gene. Other mutations in sarcomeric genes associated with hypertrophic cardiomyopathy are known to those of skill in the art (see, e.g., Moore et al., Circulation Research, Vol. 111: 375-385, 2012, which hereby incorporated by reference in its entirety), and can be used to identify a subject at risk of developing pathologic cardiac hypertrophy or hypertrophic cardiomyopathy. In other particular embodiments, the subject at risk may have a familial history of pathologic cardiac hypertrophy or hypertrophic cardiomyopathy.

In another embodiment, the present invention provides compositions and methods for inhibiting the expression or activity of β-MHC in cardiac cells of a subject comprising administering an inhibitor of MYH7B to the subject. In yet another embodiment, the present invention provides compositions and methods for modulating the ratio of β-MHC/α-MHC in cardiac cells of a subject comprising administering an inhibitor of MYH7B to the subject. The administration of an inhibitor of MYH7B to the subject reduces the expression or activity of MYH7B and/or the expression or activity of β-MHC in cardiac cells of the subject compared to the expression or activity of MYH7B and β-MHC prior to the treatment with an inhibitor of MYH7B. In one embodiment, the administration of an inhibitor of MYH7B to the subject fully or partially restores the β-MHC/α-MHC ratio in cardiac cells of the subject to normal levels found in a healthy subject.

According to one aspect of the invention, administration of an inhibitor of MYH7B to the subject results in the improvement of one or more symptoms of the cardiac disorder. For instance, in one embodiment, administration of a MYH7B inhibitor results in the improvement of one or more symptoms of pathologic cardiac hypertrophy, myocardial infarction, or heart failure in the subject, or in the delay in the transition from pathologic cardiac hypertrophy to heart failure. In another embodiment, administration of a MYH7B inhibitor results in the delay in the onset of pathologic cardiac hypertrophy, myocardial infarction, or heart failure in the subject. The one or more improved symptoms may be, for example, increased exercise capacity, increased cardiac ejection volume, decreased left ventricular end diastolic pressure, decreased pulmonary capillary wedge pressure, increased cardiac output, increased cardiac index, lowered pulmonary artery pressures, decreased left ventricular end systolic and diastolic dimensions, decreased cardiac fibrosis, decreased collagen deposition in cardiac muscle, decreased left and right ventricular wall stress, decreased wall tension, increased quality of life, and decreased disease-related morbidity or mortality.

In some embodiments, an inhibitor of MYH7B is an aptamer. The term "aptamer" as used herein refers to a nucleic acid molecule having a specific binding affinity for a particular target molecule through interactions other than classic Watson-Crick base pairing. The aptamer can inhibit the activity or function of a target molecule by binding to the target molecule. In some embodiments, the aptamer of the present invention binds to one or more epitopes of the MYH7B protein. In certain embodiments, the aptamer binds to the human MYH7B protein. The anti-MYH7B aptamers may be comprised of ribonucleotides, deoxyribonucleotides, modified nucleotides, or mixtures thereof. For example, the aptamers may contain one or more 2'-O-alkyl (e.g. 2'-O-methyl) or 2'-halo (e.g. 2'-fluoro) modifications. In some embodiments the aptamer may be conjugated to a polymer, e.g. PEG polymer, to enhance the circulating half-life of the aptamer.

An aptamer for MYH7B can be identified using systematic evolution of ligands by exponential enrichment (SELEX) (Tuerk & Gold, Science 249:505-510, 1990; Ellington & Szostak, Nature 346:818-822, 1990), such as described in U.S. Pat. No. 5,270,163. A library of nucleic acids can be contacted with a target MYH7B, and those nucleic acids specifically bound to the target are partitioned from the remainder of nucleic acids in the library which do not specifically bind the target. The partitioned nucleic acids are amplified to yield a ligand-enriched pool. Multiple cycles of binding, partitioning, and amplifying (i.e., selection) result in identification of one or more aptamers with the desired activity. Modified methods, such as Laser SELEX or deSELEX as described in U.S. Patent Publication No. 20090264508 can also be used.

In certain embodiments, the length of an aptamer useful for inhibiting the expression or activity of MYH7B is about 10 to about 30 nucleotides, about 15 to about 35 nucleotides, about 20 to about 35 nucleotides, about 20 to about 40 nucleotides, or about 25 to about 50 nucleotides.

In some embodiments, an inhibitor of MYH7B is a ribozyme. The term "ribozyme" refers to an RNA molecule having catalytic activity. Ribozymes with a variety of activities are known. Alternatively, ribozymes having a target specific RNA-cleaving activity can be designed. In certain embodiments, ribozymes that can be used as an inhibitor of MYH7B include known or artificially-created RNase P ribozymes such as group I and group II intron-type ribozymes, hammerhead ribozymes and hairpin ribozymes. In some embodiments, a ribozyme that can be used as an inhibitor of MYH7B has a length of about 200 to about 500 nucleotides or about 300 to about 450 nucleotides. In other embodiments, a ribozyme inhibitor of MYH7B may have a length of about 30 to about 100 nucleotides, about 40 to about 80 nucleotides, or about 40 to about 60 nucleotides.

In one embodiment, an inhibitor of MYH7B is a small interfering RNA. As used herein, the terms "small interfering" or "short interfering RNA" or "siRNA" refer to an RNA duplex of nucleotides that is targeted to MYH7B gene and is capable of inhibiting the expression of MYH7B gene. In certain embodiments, the siRNA that may be used as an inhibitor of MYH7B comprises two complementary single-stranded RNAs of about 10 to about 30 nucleotides, particularly, 15, 16, 17, 18, 19, 20, 21, 22, 23, 24, 25, or 30 nucleotides that form 15, 16, 17, 18, 19, 20, 21, 22, 23, 24, 25, or 30 base pairs and possess 5' and/or 3' overhangs of one or two nucleotides. The siRNA duplex comprises a first stand that has a sequence that is substantially identical to a sequence of MYH7B gene and a second strand that has a sequence that is partially, substantially, or fully complementary to the first strand. In certain embodiments, the first strand of a MYH7B siRNA comprises a sequence that is at least 70%, 75%, 80%, 85%, 90%, 95%, 96%, 98%, 99%, or 100% identical to a sequence of MYH7B gene and the second strand comprises a sequence that is substantially or completely complementary to the first strand. In some embodiments, the first RNA strand of an siRNA targeted to MYH7B gene is at least 70%, 75%, 80%, 85%, 90%, 95%, or 100% identical to a coding region of the human MYH7B gene (SEQ ID NO: 6). In certain embodiments, the first RNA strand of an siRNA targeted to MYH7B gene is at least 70%, 75%, 80%, 85%, 90%, 95%, or 100% identical to a sequence of 5'-GAGGCCAAGATCAA-3' (SEQ ID NO: 4). In other embodiments, the first RNA strand of an siRNA targeted to MYH7B gene is at least 70%, 75%, 80%, 85%, 90%, 95%, or 100% identical to a sequence of 5'-TGGAG-GAGCTGCAG-3' (SEQ ID NO: 5). An siRNA inhibitor of MYH7B can be administered to cardiac cells or expressed in cardiac cells from one or more vectors.

In another embodiment, an inhibitor of MYH7B is a small hairpin RNA (shRNA). As used herein, the term "shRNA" refers to an RNA duplex wherein a portion of the duplex is part of a hairpin structure (shRNA). In addition to the duplex portion, the hairpin structure may contain a loop portion positioned between the two first and the second strand that form the duplex. The loop can vary in length. In some embodiments the loop is 5, 6, 7, 8, 9, 10, 11, 12 or 13 nucleotides in length. The hairpin structure can also contain 3' or 5' overhang portions. In some aspects, the overhang is a 3' or a 5' overhang 0, 1, 2, 3, 4 or 5 nucleotides in length. The duplex portion or double-stranded region of an shRNA targeting MYH7B is from about 10 to about 30 nucleotides in length and comprises a first RNA strand that is at least 70%, 75%, 80%, 85%, 90%, 95%, 96%, 98%, 99%, or 100% identical to a sequence of the MYH7B gene and a second RNA strand that is substantially or fully complementary to the first strand. In certain embodiments, the first RNA strand of the duplex portion of an shRNA targeted to MYH7B gene is at least 70%, 75%, 80%, 85%, 90%, 95%, or 100% identical to a coding region of the human MYH7B gene (SEQ ID NO: 6). In some embodiments, the first RNA strand of the duplex portion of an shRNA targeted to MYH7B gene is at least 70%, 75%, 80%, 85%, 90%, 95%, or 100% identical to a sequence of 5'-GAGGCCAAGATCAA-3' (SEQ ID NO: 4). In other embodiments, the first RNA strand of an shRNA targeted to MYH7B gene is at least 70%, 75%, 80%, 85%, 90%, 95%, or 100% identical to a sequence of 5'-TGGAGGAGCTGCAG-3' (SEQ ID NO: 5). An shRNA inhibitor of MYH7B can be administered to cardiac cells or expressed in cardiac cells from a vector.

Similar to antisense oligonucleotides, other inhibitory nucleotide molecules described herein (aptamers, ribozymes, siRNA, shRNA) may contain one or more chemically-modified nucleotides described above. For example, an inhibitory nucleotide molecule targeted to MYH7B can contain bicyclic sugar nucleoside (BSN) modifications, locked nucleic acid (LNA) modifications, sugar modifications, such as 2'-O-alkyl (e.g. 2'-O-methyl, 2'-O-methoxyethyl), 2'-halo (e.g., 2'-fluoro, 2'-chloro, 2'-bromo), and 4' thio modifications, backbone modifications, such as one or more phosphorothioate, morpholino, or phosphonocarboxylate linkages, base modifications such as 5-methyl cytidine or 2'-4'-bridged bicyclic nucleoside modifications.

In yet another embodiment, an inhibitor of MYH7B is an antibody or a binding fragment thereof that specifically binds to one or more epitopes of MYH7B protein. For instance, in certain embodiments, an inhibitor of MYH7B is a monoclonal or polyclonal antibody that specifically binds to one or more epitopes of MYH7B protein. The monoclonal antibody may be chimeric or humanized. In another embodiment, an inhibitor of MYH7B is a fragment derived from an MYH7B-specific antibody, wherein the fragment specifically binds to one or more epitopes of MYH7B protein. Such binding fragments may include a Fab fragment, scFv fragment, or engineered antibody fragments such as a diabody, triabody, minibody or a single-domain antibody. Anti-MYH7B antibodies encompass all immunoglobulin classes, such as IgM, IgG, IgD, IgE, and IgA or their subclasses, including IgG subclasses (e.g., $IgG_1$, $IgG_2$, $IgG_{2a}$, $IgG_{2b}$, $IgG_3$, or $IgG_M$). Preferably, the anti-MYH7B antibodies or binding fragments thereof have a binding affinity for MYH7B in a range from about $1\times10^{-7}$ M to about $1\times10^{-12}$ M, from about $1\times10^{-8}$ M to about $1\times10^{-11}$ M, or from about $1\times10^{-9}$ M to about $5\times10^{-10}$ M.

As used herein, the term "subject" or "patient" refers to any vertebrate including, without limitation, humans and other primates (e.g., chimpanzees and other apes and monkey species), farm animals (e.g., cattle, sheep, pigs, goats and horses), domestic mammals (e.g., dogs and cats), laboratory animals (e.g., rodents such as mice, rats, and guinea pigs), and birds (e.g., domestic, wild and game birds such as chickens, turkeys and other gallinaceous birds, ducks, geese, and the like). In some embodiments, the subject is a mammal. In other embodiments, the subject is a human and an inhibitory molecule is targeted to human MYH7B gene, mRNA, pre-mRNA, or protein.

Any of the nucleic acid inhibitors of MYH7B described herein can be delivered to the target cell (e.g. cardiac cells and skeletal muscle cells) by delivering to the cell an expression vector encoding the MYH7B inhibitors. A "vector" is a composition of matter which can be used to deliver a nucleic acid of interest to the interior of a cell. Numerous vectors are known in the art including, but not limited to, linear polynucleotides, polynucleotides associated with ionic or amphiphilic compounds, plasmids, and viruses. Thus, the term "vector" includes an autonomously replicating plasmid or a virus. Examples of viral vectors include, but are not limited to, adenoviral vectors, adeno-associated virus vectors, retroviral vectors, and the like. In one particular embodiment, the viral vector is a lentiviral vector or an adenoviral vector. An expression construct can be replicated in a living cell, or it can be made synthetically. For purposes of this application, the terms "expression construct," "expression vector," and "vector," are used interchangeably to demonstrate the application of the invention in a general, illustrative sense, and are not intended to limit the invention.

In one embodiment, an expression vector for expressing an inhibitor of MYH7B comprises a promoter operably linked to a polynucleotide encoding an antisense oligonucleotide comprising a sequence of 5'-TTGATCTTGGCCTC-3' (SEQ ID NO: 145) . In another embodiment, an expression vector for expressing an inhibitor of MYH7B comprises a promoter operably linked to a polynucleotide encoding an antisense oligonucleotide comprising a sequence of 5'-CTGCAGCTCCTCCA-3' (SEQ ID NO: 147). The phrase "operably linked" or "under transcriptional control" as used herein means that the promoter is in the correct location and orientation in relation to a polynucleotide to control the initiation of transcription by RNA polymerase and expression of the polynucleotide.

As used herein, a "promoter" refers to a DNA sequence recognized by the synthetic machinery of the cell, or introduced synthetic machinery, required to initiate the specific transcription of a gene. Suitable promoters include, but are not limited to RNA pol I, pol II, pol III, and viral promoters (e.g. human cytomegalovirus (CMV) immediate early gene promoter, the SV40 early promoter, and the Rous sarcoma virus long terminal repeat). In one embodiment, the promoter is a tissue-specific promoter. Of particular interest are muscle specific promoters, and more particularly, endothelial and cardiac specific promoters. These include the myosin light chain-2 promoter (Franz et al. (1994) *Cardioscience*, Vol. 5(4):235-43; Kelly et al. (1995) *J. Cell Biol.*, Vol. 129(2):383-396), the alpha actin promoter (Moss et al. (1996) *Biol. Chem.*, Vol. 271(49):31688-31694), the troponin 1 promoter (Bhaysar et al. (1996) *Genomics*, Vol. 35(1):11-23); the Na+/Ca2+ exchanger promoter (Barnes et al. (1997) *J. Biol. Chem.*, Vol. 272(17):11510-11517), the dystrophin promoter (Kimura et al. (1997) *Dev. Growth Differ.*, Vol. 39(3):257-265), the alpha7 integrin promoter (Ziober and Kramer (1996) *J. Bio. Chem.*, Vol. 271(37): 22915-22), the brain natriuretic peptide promoter (LaPointe et al. (1996) *Hypertension*, Vol. 27(3 Pt 2):715-22) and the alpha B-crystallin/small heat shock protein promoter (Gopal-Srivastava (1995) *J. Mol. Cell. Biol.*, Vol. 15(12):7081-7090), alpha myosin heavy chain promoter (Yamauchi-Takihara et al. (1989) *Proc. Natl. Acad. Sci. USA*, Vol. 86(10):3504-3508) and the ANF promoter (LaPointe et al. (1988) *J. Biol. Chem.*, Vol. 263(19):9075-9078).

In certain embodiments, the promoter operably linked to a polynucleotide encoding a MYH7B inhibitor can be an inducible promoter. Inducible promoters are known in the art and include, but are not limited to, tetracycline promoter, metallothionein HA promoter, heat shock promoter, steroid/thyroid hormone/retinoic acid response elements, the adenovirus late promoter, and the inducible mouse mammary tumor virus LTR.

Methods of delivering expression constructs and nucleic acids to cells are known in the art and can include, for example, calcium phosphate co-precipitation, electroporation, microinjection, DEAE-dextran, lipofection, transfection employing polyamine transfection reagents, cell sonication, gene bombardment using high velocity microprojectiles, and receptor-mediated transfection.

The present invention also includes pharmaceutical compositions comprising an inhibitor of MYH7B (e.g. antisense oligonucleotide, aptamer, ribozyme, siRNA, shRNA, or antibody) and a pharmaceutically acceptable carrier or excipient. For instance, the present invention provides compositions comprising an antisense oligonucleotide of MYH7B and a pharmaceutically acceptable carrier or excipient.

In one embodiment, the pharmaceutical composition comprises an effective dose of a MYH7B inhibitor and a pharmaceutically acceptable carrier. For instance, the pharmaceutical composition comprises an effective dose of an antisense oligonucleotide targeting MYH7B or an effective dose of a modified antisense oligonucleotide targeting MYH7B as described herein. In one embodiment, the pharmaceutical composition comprises an antisense oligonucleotide having a sequence of 5'-lTslTslGsdAsdTsdCsdTsdTsdGsdGsdCslCslTslC-3' (SEQ ID NO: 146). In other embodiments, the pharmaceutical composition comprises an antisense oligonucleotide having a sequence of 5'-lCslTslGsdCsdAsdGsdCsdTsdCsdCsdTslCslCslA-3' (SEQ ID NO: 148). In some other embodiments, the pharmaceutical composition comprises an antisense oligonucleotide a modified antisense oligonucleotide having a sequence selected from the sequences listed in Tables 1-5.

An "effective dose" is an amount sufficient to effect a beneficial or desired clinical result. An effective dose of an MYH7B inhibitor of the invention may be from about 1 mg/kg to about 100 mg/kg, about 2.5 mg/kg to about 50 mg/kg, or about 5 mg/kg to about 25 mg/kg. The precise determination of what would be considered an effective dose may be based on factors individual to each patient, including their size, age, type of disorder (e.g. hypertrophic cardiomyopathy, myocardial infarction, heart failure, or cardiac hypertrophy), and nature of inhibitor (e.g. antisense oligonucleotide, siRNA, shRNA, expression construct, antibody, etc). Therefore, dosages can be readily ascertained by those of ordinary skill in the art from this disclosure and the knowledge in the art.

In certain embodiments, the invention provides methods for treating or preventing pathologic cardiac hypertrophy, myocardial infarction, heart failure, or hypertrophic cardiomyopathy comprising administering an inhibitor of MYH7B and a second therapeutic agent. In some embodiments, the second therapeutic agent is a cardiac therapeutic agent such as an antisense oligonucleotide inhibitor of miR-208a, miR-208b, miR-499, miR-15a, miR-15b, miR-16, miR-195, or combinations thereof. Exemplary inhibitors of such miR-NAs are described in WO 2012/083005 and WO 2013/192486, which are hereby incorporated by reference in their entireties. In embodiments where a second therapeutic agent is included, the second agent may be administered concurrently but in separate formulations or sequentially. In other embodiments, the second therapeutic agent may be administered at different times prior to or after administration of a MYH7B inhibitor. Prior administration includes, for instance, administration of the first agent within the range of about one week to up to 30 minutes prior to administration of the second agent. Prior administration may also include, for instance, administration of the first agent within the range of about 2 weeks to up to 30 minutes prior to administration of the second agent. After or later administration includes, for instance, administration of the second agent within the range of about one week to up to 30 minutes after administration of the first agent. After or later administration may also include, for instance, administration of the second agent within the range of about 2 weeks to up to 30 minutes after administration of the first agent.

The present invention includes pharmaceutical compositions comprising an inhibitor of MYH7B, a second therapeutic agent and a pharmaceutically acceptable carrier or excipient. In certain embodiments, the pharmaceutical composition may comprise two or more inhibitors of MYH7B. In some embodiments, the second therapeutic agent is a cardiac therapeutic agent such as an antisense oligonucleotide inhibitor of miR-208a, miR-208b, miR-499, miR-15a, miR-15b, miR-16, miR-195, or combinations thereof. In these embodiments, the second therapeutic agent may be included in the same formulation as an inhibitor of MYH7B or in a separate formulation. Where clinical applications are contemplated, pharmaceutical compositions will be prepared in a form appropriate for the intended application. Generally, this will entail preparing compositions that are essentially free of pyrogens, as well as other impurities that could be harmful to humans or animals.

Colloidal dispersion systems, such as macromolecule complexes, nanocapsules, microspheres, beads, and lipid-based systems including oil-in-water emulsions, micelles, mixed micelles, and liposomes, may be used as delivery vehicles for the oligonucleotide inhibitors of MYH7B, or constructs expressing MYH7B nucleotide inhibitors. Commercially available fat emulsions that are suitable for delivering the nucleic acids of the invention to cardiac and skeletal muscle tissues include Intralipid®, Liposyn®, Liposyn® II, Liposyn® III, Nutrilipid, and other similar lipid emulsions. A preferred colloidal system for use as a delivery vehicle in vivo is a liposome (i.e., an artificial membrane vesicle). The preparation and use of such systems is well known in the art. Exemplary formulations are also disclosed in U.S. Pat. Nos. 5,981,505; 6,217,900; 6,383,512; 5,783,565; 7,202,227; 6,379,965; 6,127,170; 5,837,533; 6,747,014; and WO03/093449, which are herein incorporated by reference in their entireties.

In certain embodiments, liposomes used for delivery are amphoteric liposomes such SMARTICLES® (Marina Biotech, Inc.) which are described in detail in U.S. Pre-grant Publication No. 20110076322. The surface charge on the SMARTICLES® is fully reversible which make them particularly suitable for the delivery of nucleic acids. SMARTICLES® can be delivered via injection, remain stable, and aggregate free and cross cell membranes to deliver the nucleic acids In some embodiments, appropriate salts and buffers are used to render delivery vehicles stable and allow for uptake by target cells. Aqueous compositions of the present invention comprise an effective amount of the delivery vehicle comprising the inhibitor polynucleotides (e.g. liposomes or other complexes or expression vectors) dissolved or dispersed in a pharmaceutically acceptable carrier or aqueous medium. The phrases "pharmaceutically acceptable" or "pharmacologically acceptable" refers to molecular entities and compositions that do not produce adverse, allergic, or other untoward reactions when administered to an animal or a human. As used herein, "pharmaceutically acceptable carrier" includes solvents, buffers, solutions, dispersion media, coatings, antibacterial and antifungal agents, isotonic and absorption delaying agents and the like acceptable for use in formulating pharmaceuticals, such as pharmaceuticals suitable for administration to humans. The use of such media and agents for pharmaceutically active substances is well known in the art. Except insofar as any conventional media or agent is incompatible with the active ingredients of the present invention, its use in therapeutic compositions is contemplated. Supplementary active ingredients also can be incorporated into the compositions, provided they do not inactivate the vectors or polynucleotides of the compositions.

The active compositions of the present invention may include classic pharmaceutical preparations. Administration of these compositions according to the present invention may be via any common route so long as the target tissue is available via that route. This includes oral, nasal (inhalational), or buccal. Alternatively, administration may be by intradermal, subcutaneous, intramuscular, intraperitoneal or intravenous injection, or by direct injection into cardiac tissue. Pharmaceutical compositions comprising MYH7B inhibitors or expression constructs comprising MYH7B inhibitors may also be administered by catheter systems or systems that isolate coronary circulation for delivering therapeutic agents to the heart. Various catheter systems for delivering therapeutic agents to the heart and coronary vasculature are known in the art. Some non-limiting examples of catheter-based delivery methods or coronary isolation methods suitable for use in the present invention are disclosed in U.S. Pat. Nos. 6,416,510; 6,716,196; 6,953,466, WO 2005/082440, WO 2006/089340, U.S. Patent Publication No. 2007/0203445, U.S. Patent Publication No. 2006/0148742, and U.S. Patent Publication No. 2007/0060907, which are all herein incorporated by reference in their entireties. Such compositions would normally be administered as pharmaceutically acceptable compositions as described herein.

In another embodiment of the invention, compositions comprising MYH7B inhibitors as described herein may be formulated as a coating for a medical device, such as a stent, balloon, or catheter. Particularly useful in methods of treating cardiac disorders in a subject, the inhibitors of MYH7B can be used to coat a metal stent to produce a drug-eluting stent. A drug-eluting stent is a scaffold that holds open narrowed or diseased arteries and releases a compound to prevent cellular proliferation and/or inflammation. The inhibitors of MYH7B may be applied to a metal stent imbedded in a thin polymer for release of the inhibitors over time. Methods for device-based delivery and methods of coating devices are well known in the art, as are drug-eluting stents and other implantable devices. See, e.g., U.S. Pat. Nos. 7,294,329, 7,273,493, 7,247,313, 7,236,821, 7,232,573, 7,156,869, 7,144,422, 7,105,018, 7,087,263, 7,083,642, 7,055,237, 7,041,127, 6,716,242, and 6,589,286, and WO 2004/004602, which are herein incorporated by reference in their entireties. Thus, the present invention includes a medical device, such as a balloon, catheter, or stent, coated with a MYH7B inhibitor. In some embodiments, the MYH7B inhibitor can be used in combination with other therapeutic agents (e.g. anti-restenosis compounds) to produce a formulation for incorporation into drug-eluting stents.

The active compounds may also be administered parenterally or intraperitoneally. By way of illustration, solutions of the active compounds as free base or pharmacologically acceptable salts can be prepared in water suitably mixed with a surfactant, such as hydroxypropylcellulose. Dispersions can also be prepared in glycerol, liquid polyethylene glycols, and mixtures thereof and in oils. Under ordinary conditions of storage and use, these preparations generally contain a preservative to prevent the growth of microorganisms.

The pharmaceutical forms suitable for injectable use or catheter delivery include, for example, sterile aqueous solutions or dispersions and sterile powders for the extemporaneous preparation of sterile injectable solutions or dispersions. Generally, these preparations are sterile and fluid to the extent that easy injectability exists. Preparations should be stable under the conditions of manufacture and storage and should be preserved against the contaminating action of microorganisms, such as bacteria and fungi. Appropriate solvents or dispersion media may contain, for example, water, ethanol, polyol (for example, glycerol, propylene glycol, and liquid polyethylene glycol, and the like), suitable mixtures thereof, and vegetable oils. The proper fluidity can be maintained, for example, by the use of a coating, such as lecithin, by the maintenance of the required particle size in the case of dispersion and by the use of surfactants. The prevention of the action of microorganisms can be brought about by various antibacterial and antifungal agents, for example, parabens, chlorobutanol, phenol, sorbic acid, thimerosal, and the like. In many cases, it will be preferable to include isotonic agents, for example, sugars or sodium chloride. Prolonged absorption of the injectable compositions can be brought about by the use in the compositions of agents delaying absorption, for example, aluminum monostearate and gelatin.

Sterile injectable solutions may be prepared by incorporating the active compounds in an appropriate amount into a solvent along with any other ingredients (for example as enumerated above) as desired, followed by filtered sterilization. Generally, dispersions are prepared by incorporating the various sterilized active ingredients into a sterile vehicle which contains the basic dispersion medium and the desired other ingredients, e.g., as enumerated above. In the case of sterile powders for the preparation of sterile injectable solutions, the preferred methods of preparation include vacuum-drying and freeze-drying techniques which yield a powder of the active ingredient(s) plus any additional desired ingredient from a previously sterile-filtered solution thereof.

The compositions of the present invention generally may be formulated in a neutral or salt form. Pharmaceutically-acceptable salts include, for example, acid addition salts (formed with the free amino groups of the protein) derived from inorganic acids (e.g., hydrochloric or phosphoric acids), or from organic acids (e.g., acetic, oxalic, tartaric, mandelic, and the like). Salts formed with the free carboxyl groups of the protein can also be derived from inorganic bases (e.g., sodium, potassium, ammonium, calcium, or ferric hydroxides) or from organic bases (e.g., isopropylamine, trimethylamine, histidine, procaine and the like).

Upon formulation, solutions are preferably administered in a manner compatible with the dosage formulation and in such amount as is therapeutically effective. The formulations may easily be administered in a variety of dosage forms such as injectable solutions, drug release capsules, eye drops, intravitreal injections, drug-eluting stents or other coated vascular devices, and the like. For parenteral administration in an aqueous solution, for example, the solution generally is suitably buffered and the liquid diluent first rendered isotonic for example with sufficient saline or glucose. Such aqueous solutions may be used, for example, for intravenous, intramuscular, subcutaneous, intravitreal and intraperitoneal administration. Preferably, sterile aqueous media are employed as is known to those of skill in the art, particularly in light of the present disclosure. By way of illustration, a single dose may be dissolved in 1 ml of isotonic NaCl solution and either added to 1000 ml of hypodermoclysis fluid or injected at the proposed site of infusion, (see for example, "Remington's Pharmaceutical Sciences" 15th Edition, pages 1035-1038 and 1570-1580). Some variation in dosage will necessarily occur depending on the condition of the subject being treated. The person responsible for administration will, in any event, determine the appropriate dose for the individual subject. Moreover, for human administration, preparations should meet sterility, pyrogenicity, general safety and purity standards as required by regulatory agencies.

In certain embodiments of the invention, the pharmaceutical compositions of the invention are packaged with or stored within a device for administration. Devices for injectable formulations include, but are not limited to, injection ports, autoinjectors, injection pumps, and injection pens. Devices for aerosolized or powder formulations include, but are not limited to, inhalers, insufflators, aspirators, and the like. Thus, the present invention includes administration devices comprising a pharmaceutical composition of the invention for treating or preventing one or more of the disorders described herein.

This invention is further illustrated by the following additional examples that should not be construed as limiting. Those of skill in the art should, in light of the present disclosure, appreciate that many changes can be made to the specific embodiments which are disclosed and still obtain a like or similar result without departing from the spirit and scope of the invention.

All patent and non-patent documents referenced throughout this disclosure are incorporated by reference herein in their entirety for all purposes.

EXAMPLES

Example 1

Inhibition of MYH7B Down-Regulates MYH7

Figure 1B:
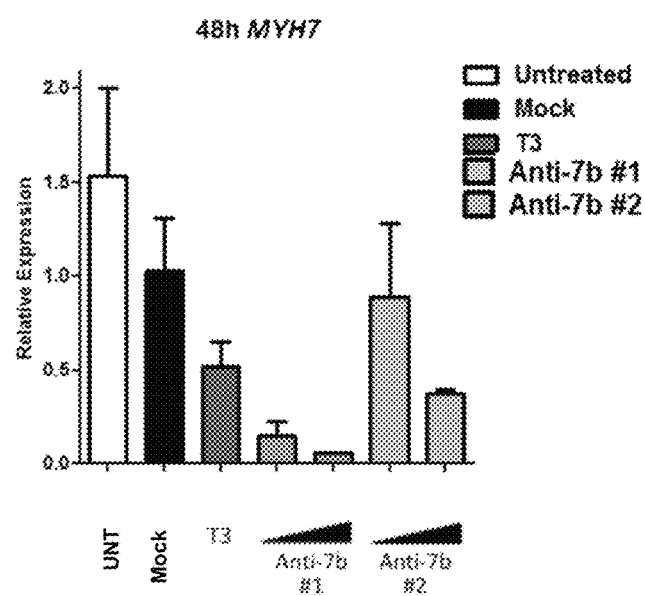
FIG. 1B shows levels of MYH7 (β-MHC) mRNA in human iPS cardiomyocytes 48 hours after transfection with antisense oligonucleotides to MYH7B.
Figures 2A, 2B, 2C:
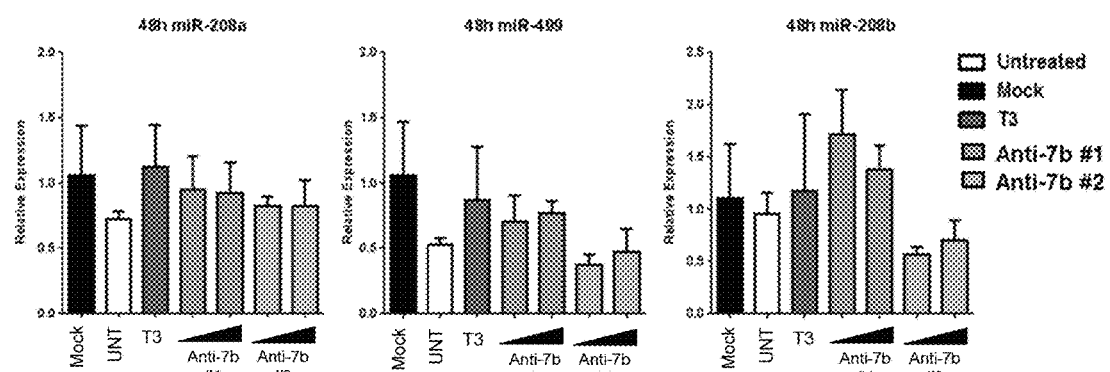
FIG. 2A shows levels of miR-208a in human iPS cardiomyocytes 48 hours after transfection with antisense oligonucleotides to MYH7B.
FIG. 2B shows levels of miR-499 in human iPS cardiomyocytes 48 hours after transfection with antisense oligonucleotides to MYH7B.
FIG. 2C shows levels of miR-208b in human iPS cardiomyocytes 48 hours after transfection with antisense oligonucleotides to MYH7B.

Human iPS cardiomyocytes were transfected with a control oligonucleotide or antisense oligonucleotides (Anti-7b #1 (5'-GTGAATGCGGATGAA-3'; SEQ ID NO: 1) and Anti-7b #2 (5'-GAAGTGGTAGTCATA-3'; SEQ ID NO: 2) targeted to MYH7B. The levels of MYH7B and MYH7 (β-MHC) mRNA were measured at 48 hours using real-time PCR. Human iPS cardiomyocytes treated with a thyroid hormone, T3, were used as a positive control. It is known that T3 down-regulates the expression of β-MHC. The real-time PCR analysis of RNA isolated from the transfected cells showed that the inhibition of MYH7B resulted in the down-regulation of MYH7B as well as MYH7 (β-MHC) (FIG. 1). As expected, T3 down-regulated MYH7 (β-MHC) (FIG. 1B) but did not affect the levels MYH7B or miR-208a, miR-208b, and miR-499 (FIGS. 1A and 2).

The observation that MYH7B knockdown results in the myosin switch could, in part, be through the regulation of the myosin's intronic miRNAs (MYH7B, miR-499; MYH7, miR-208b; MYH6, miR-208a). Therefore, we tested whether the inhibition of MYH7B in human iPS cardiomyocytes affects the expression of the myomiRs, miR-208a, miR-208b, or miR-499.

Specifically, to determine if the down-regulation of MYH7B had any effect on the expression of myomiRs (miR-208a, miR-499, and miR-208b), the levels of miR-208a, miR-499, and miR-208b were measured 48 hours after transfection. No significant effect was observed on the expression of miR-208a, miR-499, or miR-208b (FIG. 2). Over time, there could be a down-regulation of miR-208b because of the downregulation of MYH7; however, the data in FIG. 2 shows that antisense oligonucleotides directed to MYH7B do not directly or immediately affect the expression of myomiRs. Therefore, the regulation of the myosin switch by inhibition of MYH7B represents a novel, miRNA-independent mechanism in cardiac cells.

It has been shown that miR-208a acts upstream of miR-499 and is required for post-natal miR-499, MYH7B, and β-MHC expression in rodents (van Rooji et al., "Control of stress-dependent cardiac growth and gene expression by a microRNA," Science, 2007, 316(5824), 575-579; Montgomery et al., "Therapeutic inhibition of miR-208a improves cardiac function and survival during heart failure," Circulation, 2011, 124(14), 1537-1547). Loss of miR-499 and MYH7B are required for β-MHC down-regulation in the heart in rodents (van Rooji et al., "A family of microRNAs encoded by myosin genes governs myosin expression and muscle performance," Dev. Cell, 2009, 17, 662-673). Although these studies show that myomiRs play an important role in the regulation of β-MHC expression in α-MHC predominant species such as rodents, studies in β-MHC predominant species such as pigs, rabbits, and humans indicate that alternative mechanisms are likely involved in regulating the expression of β-MHC in β-MHC predominant species.

Example 2

Inhibition of MYH7B in iPS Cardiac Cells Derived from a Patient with Hypertrophic Cardiomyopathy Down-Regulates MYH7

Figure 3A:
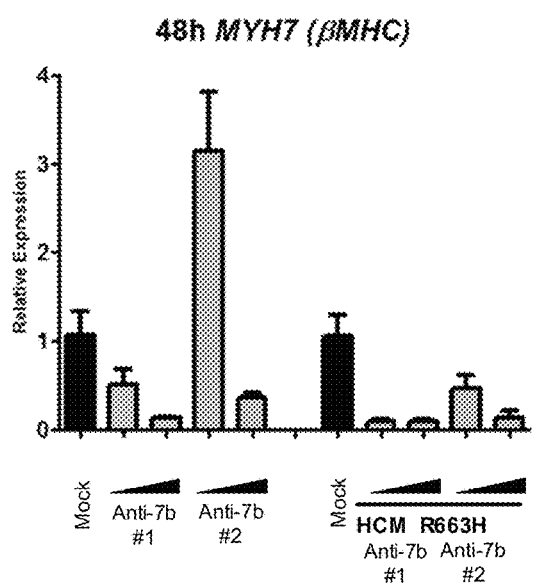
FIG. 3A shows levels of MYH7 (β-MHC) mRNA in control and HCM-R663H cardiomyocytes 48 hours after transfection with antisense oligonucleotides to MYH7B.
Figure 3B:
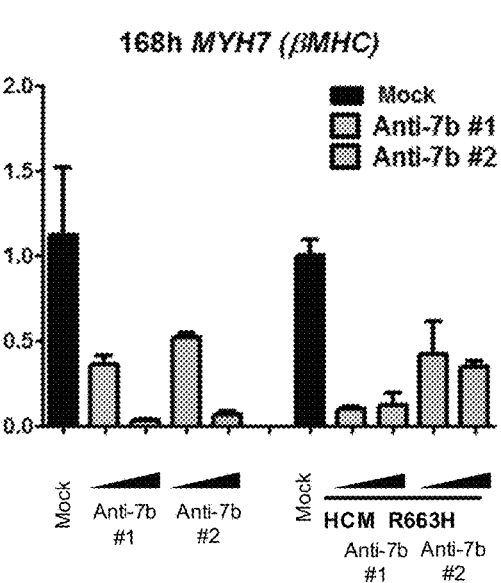
FIG. 3B shows levels of MYH7 (β-MHC) mRNA in control and HCM-R663H cardiomyocytes 168 hours (1 week) after transfection with antisense oligonucleotides to MYH7B.

Control iPS cardiomyocytes and iPS cardiomyocytes derived from patients with hypertrophic cardiomyopathy (HCM) having a mutation R663H were transfected with a control oligonucleotide or MYH7B antisense oligonucleotides (Anti-7b #1 and Anti-7b #2; SEQ ID NOs: 1 and 2). The levels of MYH7 (β-MHC) mRNA were measured at 48 hours and 1 week (168 hours) post-transfection using real-time PCR. The real-time PCR analysis showed that the inhibition of MYH7B resulted in the down-regulation of MYH7 (β-MHC) expression in HCM cardiomyocytes (FIG. 3A). Moreover, the down-regulation in the expression of MYH7 (β-MHC) was sustained up to 1 week post-treatment (FIG. 3B).

Example 3

Inhibition of MYH7B Down-Regulates β-MHC Protein

Figure 4:
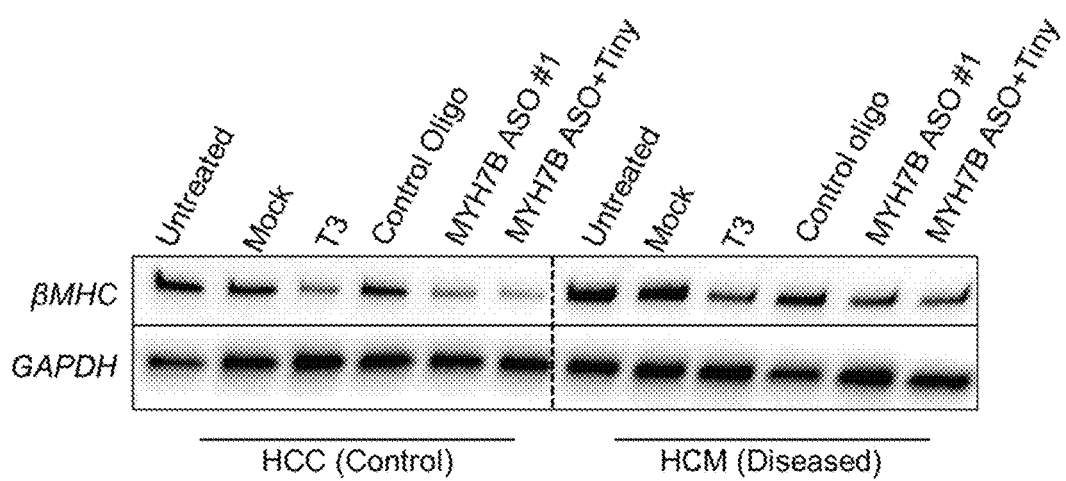
FIG. 4 shows a Western blot analysis of MYH7 (β-MHC) or GAPDH from control and HCM iPS cardiomyocytes at 96 hours post-treatment.

To determine if inhibition of MYH7B results in the down-regulation of MYH7 at the protein level, control and HCM R663H human iPS cardiomyocytes were transfected with a control oligonucleotide, MYH7B ASO #1 (SEQ ID NO: 1), MYH7B ASO and TINY. TINY is a 8mer oligo complementary to the seed regions of miR-208a, miR-208b, and miR-499. The levels of MYH7 (β-MHC) protein were assessed by western blot analysis. The results showed that the treatment of control or HCM iPS cardiomyocytes using MYH7B antisense oligonucleotides significantly down-regulated the MYH7 (β-MHC) protein at 96 hours post-treatment (FIG. 4). A control oligo showed no effect. T3 was used as a positive control.

Example 4

Screening of Antisense Oligonucleotides (ASOs) Directed to MYH7B

Figure 5:
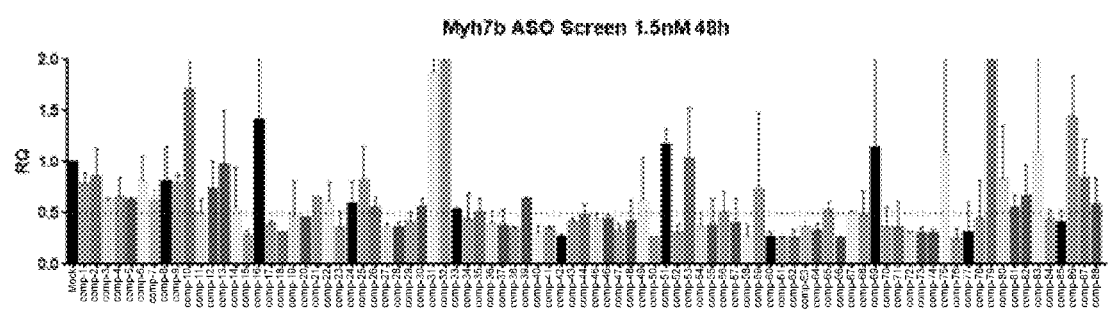
FIG. 5 shows levels of MYH7B mRNA in human iPS cardiomyocytes 48 hrs after transfection with test ASO compounds to MYH7B.

Human iPS cardiomyocytes were transfected with a control oligonucleotide (Mock) or 1.5 nM of test ASOs targeted to MYH7B. The levels of MYH7B mRNA were measured at 48 hours using real-time PCR (FIG. 5). A number of ASOs showed greater than 50% inhibition of MYH7B levels. Specifically, the following ASO compounds were tested:

TABLE 6

| CPD # | SEQ ID NO: |
|---|---|
| Comp-1 | SEQ ID NO: 52 |
| Comp-2 | SEQ ID NO: 8 |
| Comp-3 | SEQ ID NO: 22 |
| Comp-4 | SEQ ID NO: 82 |
| Comp-5 | SEQ ID NO: 96 |
| Comp-6 | SEQ ID NO: 110 |
| Comp-7 | SEQ ID NO: 3 |
| Comp-8 | SEQ ID NO: 140 |
| Comp-9 | SEQ ID NO: 154 |
| Comp-10 | SEQ ID NO: 170 |
| Comp-11 | SEQ ID NO: 38 |
| Comp-12 | SEQ ID NO: 54 |
| Comp-13 | SEQ ID NO: 24 |
| Comp-14 | SEQ ID NO: 68 |
| Comp-15 | SEQ ID NO: 84 |
| Comp-16 | SEQ ID NO: 98 |
| Comp-17 | SEQ ID NO: 112 |
| Comp-18 | SEQ ID NO: 126 |
| Comp-19 | SEQ ID NO: 142 |
| Comp-20 | SEQ ID NO: 156 |
| Comp-21 | SEQ ID NO: 172 |
| Comp-22 | SEQ ID NO: 56 |
| Comp-23 | SEQ ID NO: 10 |
| Comp-24 | SEQ ID NO: 26 |
| Comp-25 | SEQ ID NO: 70 |
| Comp-26 | SEQ ID NO: 86 |
| Comp-27 | SEQ ID NO: 100 |
| Comp-28 | SEQ ID NO: 114 |
| Comp-29 | SEQ ID NO: 128 |
| Comp-30 | SEQ ID NO: 144 |
| Comp-31 | SEQ ID NO: 158 |
| Comp-32 | SEQ ID NO: 174 |
| Comp-33 | SEQ ID NO: 42 |
| Comp-34 | SEQ ID NO: 58 |
| Comp-35 | SEQ ID NO: 12 |
| Comp-36 | SEQ ID NO: 28 |
| Comp-37 | SEQ ID NO: 72 |
| Comp-38 | SEQ ID NO: 88 |
| Comp-39 | SEQ ID NO: 102 |
| Comp-40 | SEQ ID NO: 116 |
| Comp-41 | SEQ ID NO: 130 |
| Comp-42 | SEQ ID NO: 146 |
| Comp-43 | SEQ ID NO: 160 |
| Comp-44 | SEQ ID NO: 176 |
| Comp-45 | SEQ ID NO: 44 |
| Comp-46 | SEQ ID NO: 60 |
| Comp-47 | SEQ ID NO: 14 |
| Comp-48 | SEQ ID NO: 30 |
| Comp-49 | SEQ ID NO: 74 |
| Comp-50 | SEQ ID NO: 90 |
| Comp-51 | SEQ ID NO: 104 |
| Comp-52 | SEQ ID NO: 118 |
| Comp-53 | SEQ ID NO: 132 |

TABLE 6-continued

| CPD # | SEQ ID NO: |
|---|---|
| Comp-54 | SEQ ID NO: 148 |
| Comp-55 | SEQ ID NO: 162 |
| Comp-56 | SEQ ID NO: 178 |
| Comp-57 | SEQ ID NO: 46 |
| Comp-58 | SEQ ID NO: 62 |
| Comp-59 | SEQ ID NO: 16 |
| Comp-60 | SEQ ID NO: 32 |
| Comp-61 | SEQ ID NO: 76 |
| Comp-62 | SEQ ID NO: 92 |
| Comp-63 | SEQ ID NO: 3 |
| Comp-64 | SEQ ID NO: 120 |
| Comp-65 | SEQ ID NO: 134 |
| Comp-66 | SEQ ID NO: 150 |
| Comp-67 | SEQ ID NO: 164 |
| Comp-68 | SEQ ID NO: 180 |
| Comp-69 | SEQ ID NO: 48 |
| Comp-70 | SEQ ID NO: 64 |
| Comp-71 | SEQ ID NO: 18 |
| Comp-72 | SEQ ID NO: 34 |
| Comp-73 | SEQ ID NO: 78 |
| Comp-74 | SEQ ID NO: 106 |
| Comp-75 | SEQ ID NO: 122 |
| Comp-76 | SEQ ID NO: 136 |
| Comp-77 | SEQ ID NO: 152 |
| Comp-78 | SEQ ID NO: 166 |
| Comp-79 | SEQ ID NO: 182 |
| Comp-80 | SEQ ID NO: 50 |
| Comp-81 | SEQ ID NO: 66 |
| Comp-82 | SEQ ID NO: 36 |
| Comp-83 | SEQ ID NO: 80 |
| Comp-84 | SEQ ID NO: 94 |
| Comp-85 | SEQ ID NO: 108 |
| Comp-86 | SEQ ID NO: 124 |
| Comp-87 | SEQ ID NO: 138 |
| Comp-88 | SEQ ID NO: 168 |

Example 5

Inhibition of MYH7B Upon Passive Administration of ASOs

Figures 6A, 6B:
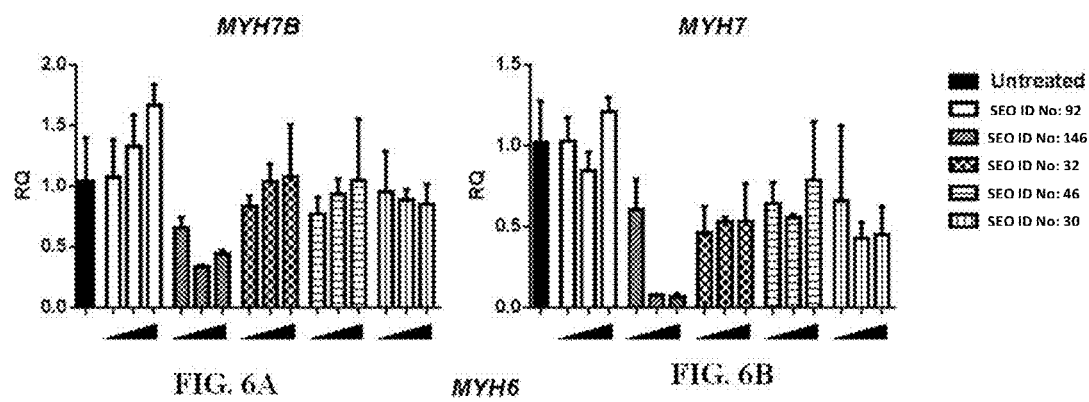
FIG. 6A shows levels of MYH7B mRNA in human iPS cardiomyocytes 168 hrs after passive administration of 1, 5, or 10 μM test ASO compounds (SEQ ID NOs. 92, 146, 32, 46, and 30) targeted to MYH7B.
FIG. 6B shows levels of MYH7 (β-MHC) mRNA in human iPS cardiomyocytes 168 hrs after passive administration of 1, 5, or 10 μM the test ASO compounds.
Figure 6C:
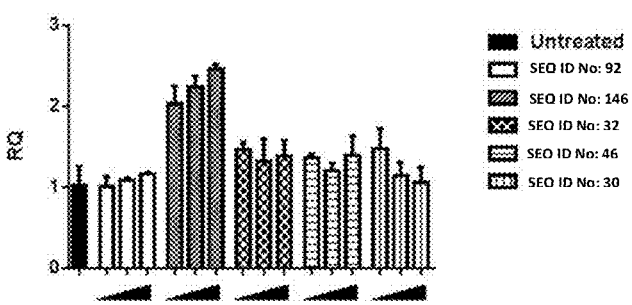
FIG. 6C shows levels of MYH6 (α-MHC) mRNA in human iPS cardiomyocytes 168 hrs after passive administration of 1, 5, or 10 μM of the test ASO compounds.

ASOs that showed more than 50% inhibition of MYH7B levels in Example 4 were further tested for their inhibitory potential upon passive uptake. Specifically, selected ASOs were incubated with human iPS cardiomyocytes for 168 hours at 1, 5, or 10 µM ASO concentrations. The levels of MYH7B, MYH7 (β-MHC), and MYH6 (α-MHC) mRNAs were measured at 168 hours using real-time PCR. The real-time PCR analysis showed that many ASOs downregulated MYH7B mRNA levels (FIG. 6A). Moreover, antisense oligonucleotide having the sequence of SEQ ID NO: 146 showed a "switch" in the levels of myosins, where β-MHC is down-regulated and α-MHC is up-regulated following inhibition of MYH7B (FIGS. 6B and 6C). Some other ASOs also showed a similar trend in the levels of β- and α-MHC (FIGS. 6B and 6C).

Figure 7:
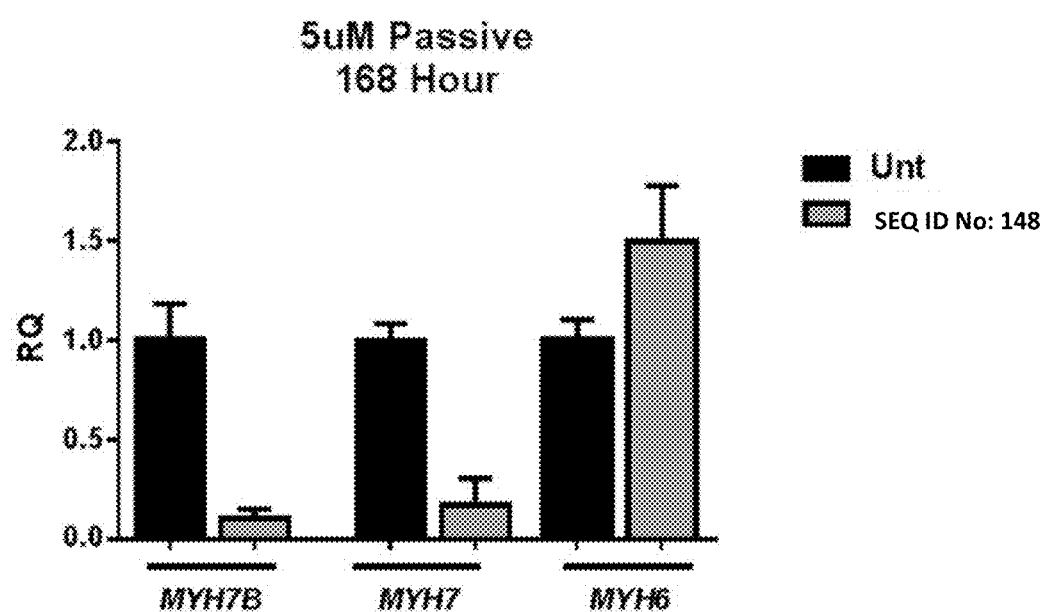
FIG. 7 shows levels of MYH7B, MYH7 (β-MHC), and MYH6 (α-MHC) mRNAs in human iPS cardiomyocytes 168 hrs after passive administration of 5 μM test ASO having the sequence of SEQ ID NO: 148.

Another ASO compound having the sequence of SEQ ID NO: 146, was also tested for its inhibitory activity upon passive uptake. Human iPS cardiomyocytes were incubated with 5 µM concentration of the compound with SEQ ID NO: 146 for 168 hours and the levels of MYH7B, MYH7 (β-MHC), and MYH6 (α-MHC) mRNAs were measured using real-time PCR. As shown in FIG. 7, the compound with SEQ ID NO: 146 also showed a "switch" in the levels of myosins, where β-MHC is down-regulated and α-MHC is up-regulated following inhibition of MYH7B.

Example 6

In Vivo Activity of Test ASOs

Figure 8:
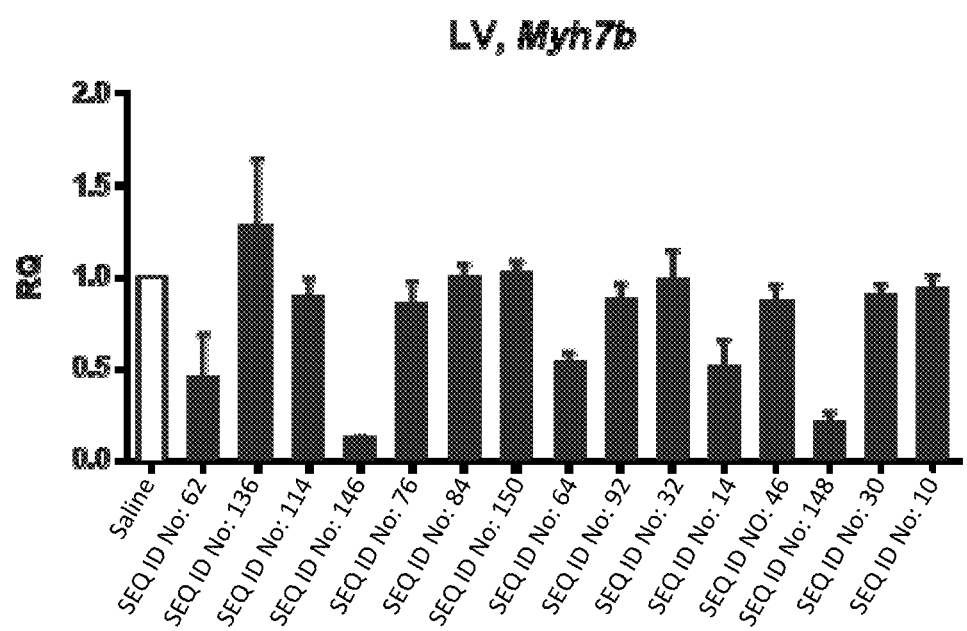
FIG. 8 shows levels of MYH7B mRNA in left ventricles of rats injected with 25 mg/kg of test ASOs per day for three consecutive days and sacrificed 48 hours after the last dose.

ASOs that showed in vitro inhibition of MYH7B were further tested for their inhibitory potential in vivo. Specifically, selected ASOs were injected subcutaneously into rats at a dose of 25 mg/kg per day for three consecutive days and rats were sacrificed 48 hours after the last dose. The levels of MYH7B mRNA in left ventricles of rats were measured using real-time PCR (FIG. 8). As shows in FIG. 8, antisense oligonucleotide compounds that showed robust activity via passive administration (e.g. SEQ ID NO: 146) also showed downregulation of MYH7B in vivo, whereas compounds that showed no activity via passive administration (e.g. SEQ ID NO: 32) also showed no activity in vivo.

Figure 9A:
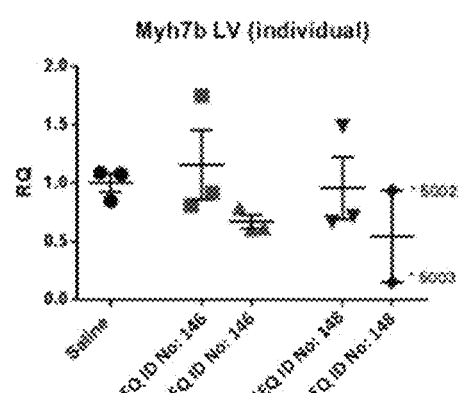
FIG. 9A shows levels of MYH7B mRNA in left ventricles of rabbits treated with ASO compounds comprising the sequence of SEQ ID NOs: 146 and 148.
Figure 9B:
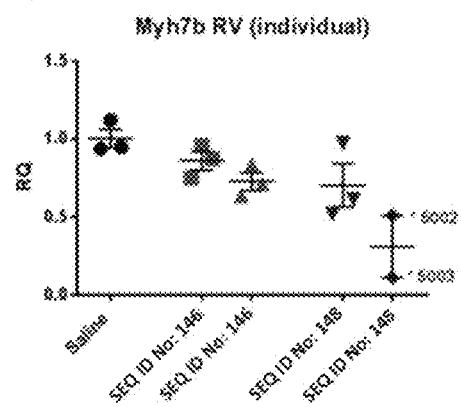
FIG. 9B shows levels of MYH7B mRNA in right ventricles of rabbits treated with ASO compounds comprising the sequence of SEQ ID NOs: 146 and 148.
Figure 9C:
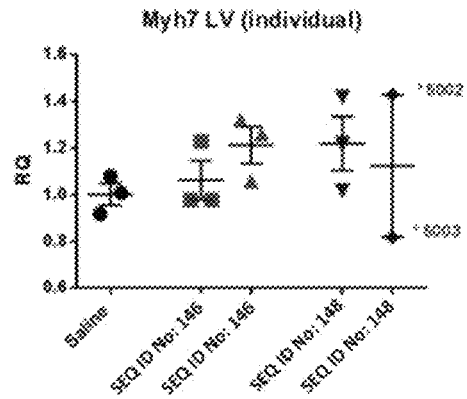
FIG. 9C shows levels of MYH7 (β-MHC) mRNA in left ventricles of rabbits treated with ASO compounds comprising the sequence of SEQ ID NOs: 146 and 148.
Figure 9D:
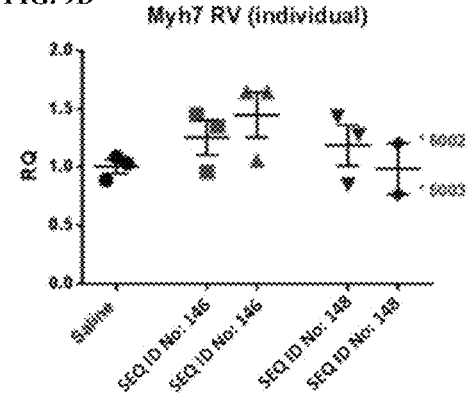
FIG. 9D shows levels of MYH7 (β-MHC) mRNA in right ventricles of rabbits treated with ASO compounds comprising the sequence of SEQ ID NOs: 146 and 148.
Figure 11A:
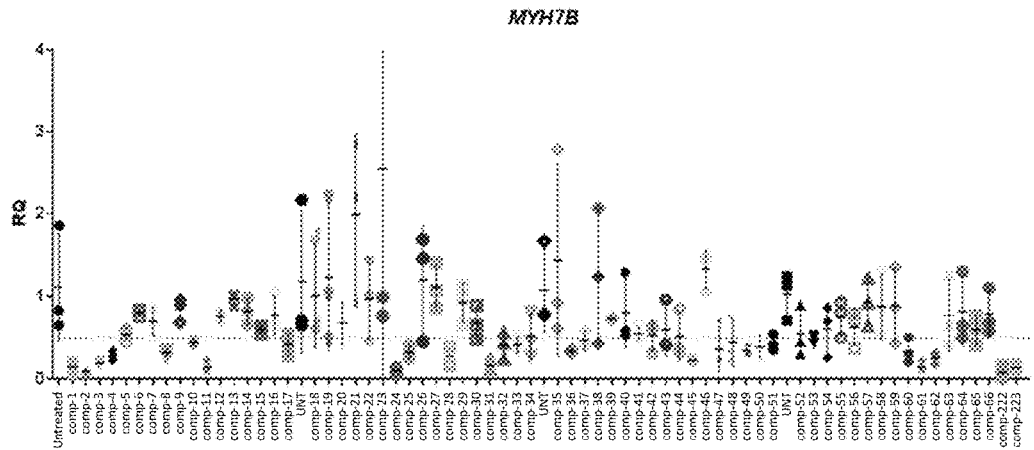
FIGS. 11A-11D show levels of MYH7B mRNA in human iPS cardiomyocytes 48 hrs after passive administration of test ASO compounds directed to MYH7B.
Figure 11B:
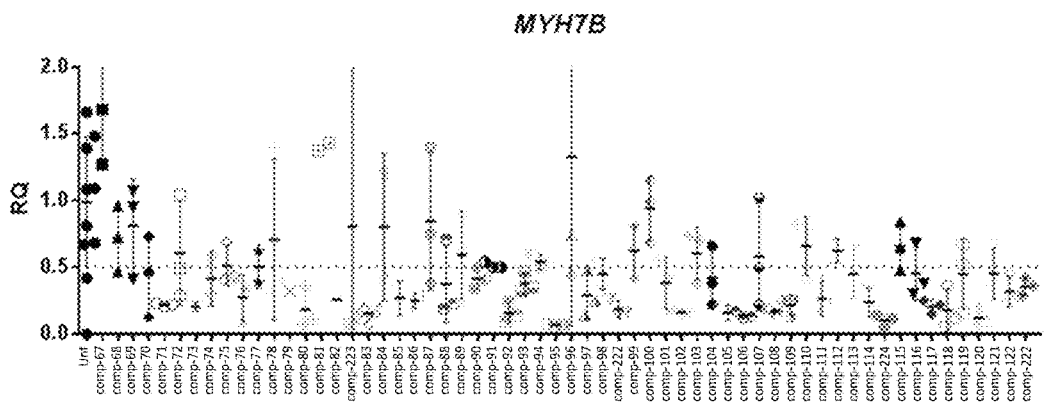
Figure 11C:
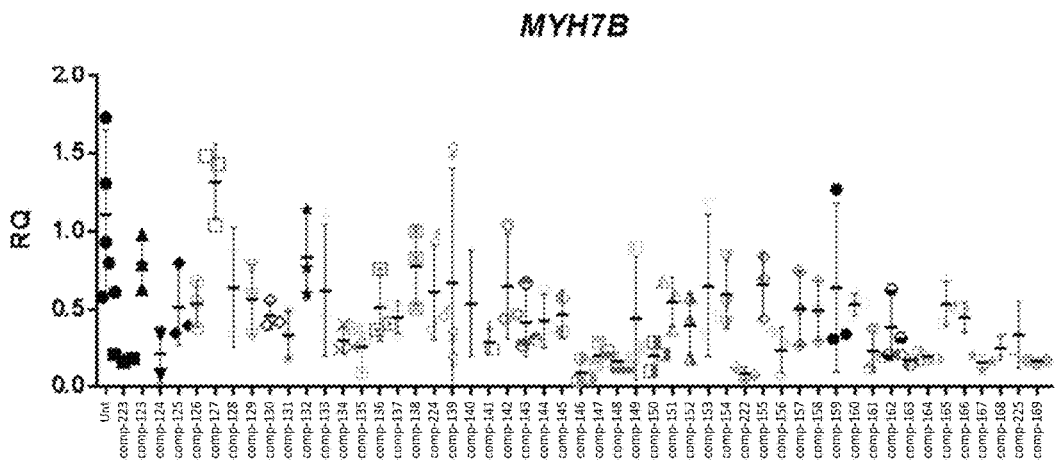
Figure 11D:
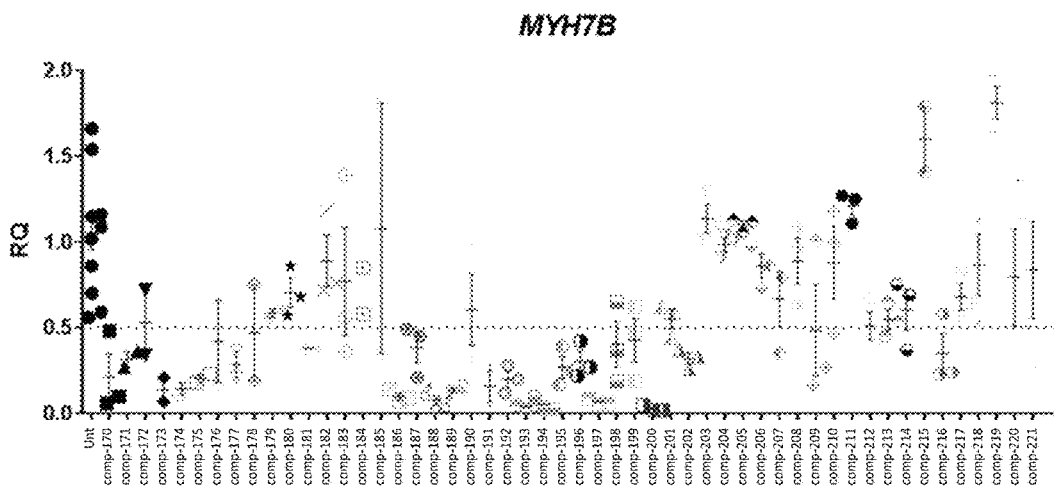

Compounds having the sequence of SEQ ID NOs: 146 and 148 that showed robust activity in rats were selected for rabbit studies for assessment in β-MHC-predominant species. Rabbits were injected with 10, 15, 20, or 25 mg/kg of compounds with SEQ ID NOs: 146 and 148 at days 1, 3, 5, 10, and 17 subcutaneously and sacrificed at day 18. Real-time PCR data for MYH7B shows a dose-dependent reduction in MYH7B in both ventricles (FIGS. 9A-9B). Further, the rabbit with the most robust inhibition of MYH7B (5003) also showed the most robust reduction in β-MHC (MYH7). See FIGS. 9C and 9D.

Example 7

Effect of Nucleotide Modifications on the Activity of MYH7B ASOs

The ASO compound with SEQ ID NO: 146 was modified at various positions to assess the effect of modifications on its activity. Modifications included substitution of LNA nucleotides with corresponding ENA nucleotides and other base and sugar modifications. FIG. 10A shows that substitution of ENA for LNA retained passive activity targeting MYH7B. Likewise, substitution of cytidine with 5'-methyl cytidine and substitution of an LNA base with 2'-O-methyl modified nucleotide retain activity (FIG. 10B). FIG. 10C shows backbone modifications greatly affect the passive activity of compounds.

Example 8

Screening of Additional ASOs

Additional antisense oligonucleotide compounds were screened for their inhibitory potential upon passive administration. Human iPS cardiomyocytes were passively treated with test compounds at 5 µM for 48 hours. The levels of MYH7B mRNA were measured at 48 hours using real-time PCR. A number of ASOs showed robust inhibition of MYH7B levels whereas other compounds showed no effect on MYH7B levels. FIGS. 11A-11D show results from 4 separate studies. Specifically, the following ASO compounds were tested.

TABLE 7

| CPD # | SEQ ID NO: |
| --- | --- |
| Comp-1 | SEQ ID NO: 184 |
| Comp-2 | SEQ ID NO: 186 |
| Comp-3 | SEQ ID NO: 188 |

TABLE 7-continued

| CPD # | SEQ ID NO: |
| --- | --- |
| Comp-4 | SEQ ID NO: 190 |
| Comp-5 | SEQ ID NO: 192 |
| Comp-6 | SEQ ID NO: 194 |
| Comp-7 | SEQ ID NO: 196 |
| Comp-8 | SEQ ID NO: 198 |
| Comp-9 | SEQ ID NO: 200 |
| Comp-10 | SEQ ID NO: 202 |
| Comp-11 | SEQ ID NO: 204 |
| Comp-12 | SEQ ID NO: 206 |
| Comp-13 | SEQ ID NO: 208 |
| Comp-14 | SEQ ID NO: 210 |
| Comp-15 | SEQ ID NO: 212 |
| Comp-16 | SEQ ID NO: 214 |
| Comp-17 | SEQ ID NO: 216 |
| Comp-18 | SEQ ID NO: 218 |
| Comp-19 | SEQ ID NO: 220 |
| Comp-20 | SEQ ID NO: 222 |
| Comp-21 | SEQ ID NO: 224 |
| Comp-22 | SEQ ID NO: 226 |
| Comp-23 | SEQ ID NO: 228 |
| Comp-24 | SEQ ID NO: 230 |
| Comp-25 | SEQ ID NO: 232 |
| Comp-26 | SEQ ID NO: 234 |
| Comp-27 | SEQ ID NO: 236 |
| Comp-28 | SEQ ID NO: 238 |
| Comp-29 | SEQ ID NO: 240 |
| Comp-30 | SEQ ID NO: 242 |
| Comp-31 | SEQ ID NO: 244 |
| Comp-32 | SEQ ID NO: 246 |
| Comp-33 | SEQ ID NO: 248 |
| Comp-34 | SEQ ID NO: 250 |
| Comp-35 | SEQ ID NO: 252 |
| Comp-36 | SEQ ID NO: 254 |
| Comp-37 | SEQ ID NO: 256 |
| Comp-38 | SEQ ID NO: 258 |
| Comp-39 | SEQ ID NO: 260 |
| Comp-40 | SEQ ID NO: 262 |
| Comp-41 | SEQ ID NO: 264 |
| Comp-42 | SEQ ID NO: 266 |
| Comp-43 | SEQ ID NO: 268 |
| Comp-44 | SEQ ID NO: 270 |
| Comp-45 | SEQ ID NO: 272 |
| Comp-46 | SEQ ID NO: 274 |
| Comp-47 | SEQ ID NO: 276 |
| Comp-48 | SEQ ID NO: 278 |
| Comp-49 | SEQ ID NO: 280 |
| Comp-50 | SEQ ID NO: 282 |
| Comp-51 | SEQ ID NO: 284 |
| Comp-52 | SEQ ID NO: 286 |
| Comp-53 | SEQ ID NO: 288 |
| Comp-54 | SEQ ID NO: 290 |
| Comp-55 | SEQ ID NO: 292 |
| Comp-56 | SEQ ID NO: 294 |
| Comp-57 | SEQ ID NO: 296 |
| Comp-58 | SEQ ID NO: 298 |
| Comp-59 | SEQ ID NO: 300 |
| Comp-60 | SEQ ID NO: 302 |
| Comp-61 | SEQ ID NO: 304 |
| Comp-62 | SEQ ID NO: 306 |
| Comp-63 | SEQ ID NO: 308 |
| Comp-64 | SEQ ID NO: 310 |
| Comp-65 | SEQ ID NO: 312 |
| Comp-66 | SEQ ID NO: 314 |
| Comp-67 | SEQ ID NO: 330 |
| Comp-68 | SEQ ID NO: 342 |
| Comp-69 | SEQ ID NO: 320 |
| Comp-70 | SEQ ID NO: 332 |
| Comp-71 | SEQ ID NO: 344 |
| Comp-72 | SEQ ID NO: 322 |
| Comp-73 | SEQ ID NO: 334 |
| Comp-74 | SEQ ID NO: 346 |
| Comp-75 | SEQ ID NO: 324 |
| Comp-76 | SEQ ID NO: 336 |
| Comp-77 | SEQ ID NO: 348 |
| Comp-78 | SEQ ID NO: 326 |
| Comp-79 | SEQ ID NO: 338 |
| Comp-80 | SEQ ID NO: 350 |
| Comp-81 | SEQ ID NO: 328 |

TABLE 7-continued

| CPD # | SEQ ID NO: |
|---|---|
| Comp-82 | SEQ ID NO: 340 |
| Comp-83 | SEQ ID NO: 362 |
| Comp-84 | SEQ ID NO: 374 |
| Comp-85 | SEQ ID NO: 352 |
| Comp-86 | SEQ ID NO: 364 |
| Comp-87 | SEQ ID NO: 376 |
| Comp-88 | SEQ ID NO: 354 |
| Comp-89 | SEQ ID NO: 366 |
| Comp-90 | SEQ ID NO: 378 |
| Comp-91 | SEQ ID NO: 356 |
| Comp-92 | SEQ ID NO: 368 |
| Comp-93 | SEQ ID NO: 380 |
| Comp-94 | SEQ ID NO: 358 |
| Comp-95 | SEQ ID NO: 370 |
| Comp-96 | SEQ ID NO: 382 |
| Comp-97 | SEQ ID NO: 360 |
| Comp-98 | SEQ ID NO: 372 |
| Comp-99 | SEQ ID NO: 394 |
| Comp-100 | SEQ ID NO: 406 |
| Comp-101 | SEQ ID NO: 384 |
| Comp-102 | SEQ ID NO: 396 |
| Comp-103 | SEQ ID NO: 408 |
| Comp-104 | SEQ ID NO: 386 |
| Comp-105 | SEQ ID NO: 398 |
| Comp-106 | SEQ ID NO: 410 |
| Comp-107 | SEQ ID NO: 388 |
| Comp-108 | SEQ ID NO: 400 |
| Comp-109 | SEQ ID NO: 412 |
| Comp-110 | SEQ ID NO: 390 |
| Comp-111 | SEQ ID NO: 402 |
| Comp-112 | SEQ ID NO: 414 |
| Comp-113 | SEQ ID NO: 392 |
| Comp-114 | SEQ ID NO: 404 |
| Comp-115 | SEQ ID NO: 426 |
| Comp-116 | SEQ ID NO: 416 |
| Comp-117 | SEQ ID NO: 316 |
| Comp-118 | SEQ ID NO: 418 |
| Comp-119 | SEQ ID NO: 318 |
| Comp-120 | SEQ ID NO: 420 |
| Comp-121 | SEQ ID NO: 422 |
| Comp-122 | SEQ ID NO: 424 |
| Comp-123 | SEQ ID NO: 428 |
| Comp-124 | SEQ ID NO: 430 |
| Comp-125 | SEQ ID NO: 432 |
| Comp-126 | SEQ ID NO: 434 |
| Comp-127 | SEQ ID NO: 436 |
| Comp-128 | SEQ ID NO: 438 |
| Comp-129 | SEQ ID NO: 440 |
| Comp-130 | SEQ ID NO: 442 |
| Comp-131 | SEQ ID NO: 444 |
| Comp-132 | SEQ ID NO: 446 |
| Comp-133 | SEQ ID NO: 448 |
| Comp-134 | SEQ ID NO: 450 |
| Comp-135 | SEQ ID NO: 452 |
| Comp-136 | SEQ ID NO: 454 |
| Comp-137 | SEQ ID NO: 456 |
| Comp-138 | SEQ ID NO: 458 |
| Comp-139 | SEQ ID NO: 460 |
| Comp-140 | SEQ ID NO: 462 |
| Comp-141 | SEQ ID NO: 464 |
| Comp-142 | SEQ ID NO: 466 |
| Comp-143 | SEQ ID NO: 468 |
| Comp-144 | SEQ ID NO: 470 |
| Comp-145 | SEQ ID NO: 472 |
| Comp-146 | SEQ ID NO: 474 |
| Comp-147 | SEQ ID NO: 476 |
| Comp-148 | SEQ ID NO: 478 |
| Comp-149 | SEQ ID NO: 480 |
| Comp-150 | SEQ ID NO: 482 |
| Comp-151 | SEQ ID NO: 484 |
| Comp-152 | SEQ ID NO: 486 |
| Comp-153 | SEQ ID NO: 488 |
| Comp-154 | SEQ ID NO: 490 |
| Comp-155 | SEQ ID NO: 492 |
| Comp-156 | SEQ ID NO: 494 |
| Comp-157 | SEQ ID NO: 496 |
| Comp-158 | SEQ ID NO: 498 |
| Comp-159 | SEQ ID NO: 500 |
| Comp-160 | SEQ ID NO: 502 |
| Comp-161 | SEQ ID NO: 504 |
| Comp-162 | SEQ ID NO: 506 |
| Comp-163 | SEQ ID NO: 508 |
| Comp-164 | SEQ ID NO: 510 |
| Comp-165 | SEQ ID NO: 512 |
| Comp-166 | SEQ ID NO: 514 |
| Comp-167 | SEQ ID NO: 516 |
| Comp-168 | SEQ ID NO: 518 |
| Comp-169 | SEQ ID NO: 522 |
| Comp-170 | SEQ ID NO: 544 |
| Comp-171 | SEQ ID NO: 524 |
| Comp-172 | SEQ ID NO: 534 |
| Comp-173 | SEQ ID NO: 546 |
| Comp-174 | SEQ ID NO: 526 |
| Comp-175 | SEQ ID NO: 536 |
| Comp-176 | SEQ ID NO: 548 |
| Comp-177 | SEQ ID NO: 528 |
| Comp-178 | SEQ ID NO: 538 |
| Comp-179 | SEQ ID NO: 550 |
| Comp-180 | SEQ ID NO: 530 |
| Comp-181 | SEQ ID NO: 540 |
| Comp-182 | SEQ ID NO: 552 |
| Comp-183 | SEQ ID NO: 532 |
| Comp-184 | SEQ ID NO: 542 |
| Comp-185 | SEQ ID NO: 554 |
| Comp-186 | SEQ ID NO: 576 |
| Comp-187 | SEQ ID NO: 556 |
| Comp-188 | SEQ ID NO: 566 |
| Comp-189 | SEQ ID NO: 578 |
| Comp-190 | SEQ ID NO: 558 |
| Comp-191 | SEQ ID NO: 568 |
| Comp-192 | SEQ ID NO: 580 |
| Comp-193 | SEQ ID NO: 560 |
| Comp-194 | SEQ ID NO: 570 |
| Comp-195 | SEQ ID NO: 582 |
| Comp-196 | SEQ ID NO: 562 |
| Comp-197 | SEQ ID NO: 572 |
| Comp-198 | SEQ ID NO: 584 |
| Comp-199 | SEQ ID NO: 564 |
| Comp-200 | SEQ ID NO: 574 |
| Comp-201 | SEQ ID NO: 586 |
| Comp-202 | SEQ ID NO: 598 |
| Comp-203 | SEQ ID NO: 588 |
| Comp-204 | SEQ ID NO: 600 |
| Comp-205 | SEQ ID NO: 610 |
| Comp-206 | SEQ ID NO: 590 |
| Comp-207 | SEQ ID NO: 602 |
| Comp-208 | SEQ ID NO: 612 |
| Comp-209 | SEQ ID NO: 592 |
| Comp-210 | SEQ ID NO: 604 |
| Comp-211 | SEQ ID NO: 614 |
| Comp-212 | SEQ ID NO: 594 |
| Comp-213 | SEQ ID NO: 606 |
| Comp-214 | SEQ ID NO: 616 |
| Comp-215 | SEQ ID NO: 596 |
| Comp-216 | SEQ ID NO: 608 |
| Comp-217 | SEQ ID NO: 618 |
| Comp-218 | SEQ ID NO: 620 |
| Comp-219 | SEQ ID NO: 622 |
| Comp-220 | SEQ ID NO: 624 |
| Comp-221 | SEQ ID NO: 626 |
| Comp-222 | SEQ ID NO: 136 |
| Comp-223 | SEQ ID NO: 146 |
| Comp-224 | SEQ ID NO: 148 |
| Comp-225 | SEQ ID NO: 520 |

SEQUENCE LISTING (792 sequences)

SEQ ID NO: 1 - DNA, 15 bp, Homo sapiens
gtgaatgcggatgaa

SEQ ID NO: 2 - DNA, 15 bp, Homo sapiens
gaagtggtagtcata

SEQ ID NO: 3 - DNA, 15 bp, Artificial Sequence
  modified nucleotide MYHB7B antisense oligonucleotide
  MISC_FEATURE (1)..(15): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged thymidine
  MOD_RES (3)..(3): May be a 2 prime O, 4 prime C methylene bridged guanosine
  MOD_RES (14)..(14): May be a 2 prime O, 4 prime C methylene bridged adenosine
  MOD_RES (15)..(15): May be a 2 prime O, 4 prime C methylene bridged adenosine
gtgaatgcggatgaa

SEQ ID NO: 4 - DNA, 14 bp, Homo sapiens
gaggccaagatcaa

SEQ ID NO: 5 - DNA, 14 bp, Homo sapiens
tggaggagctgcag

SEQ ID NO: 6 - DNA, 6602 bp, Homo sapiens
taggcttaaagagcaggcggggcagagacccatacctttggcgctgagtcgaggccaggaaggggcggtcgatgagagggcggccttagcattaggagtgcgtcggctgcaccctggcggatggaccttgggaaggaggggaggggaccatcggggtcggcggggagctacgggttcccctcttccaagacgggtgccaagtgatgagtatcaggtgtctatggtgagatttggggaggatcccagaccttaacagccctttggttgaaacctctcacaatgtggcagagatggggttttgatgtgttgcccaggctggtcttgaactcctgagcttaagtgatgtgtccgcctgggcctcccaaagtgctggaattacagacatgagtggcaataaaaggggtagcagagcttcctgccctcaccgtggtgccgagtgcctgctgccttgggccgccttgaacctccagggtttccagctcctcctccttcaccccagtgccactgccatgatggatgtgagtgaacttggggagtctgcccgctacctccgccagggctaccaggagatgacgaaggtgcacactatcccatgggacgggaagaagcgagtctgggtgcctgatgaacaggacgcctacgtggaggccgaggtcaagtcggaggctaccgggggcagagtcaccgtggagaccaaagaccagaaggtgctgatggtgcgtgaagccgagctgcagcccatgaacccgcctcgcttcgacttactggaggacatggccatgatgacgcacctgaacgaggcctctgtgctgcacaacctgcgccagcgctatgcccgctggatgatctatacctactcaggcctcttctgtgtcaccatcaacccctacaaatggctcccagtctatacggcctccgtagtggctgcttacaagggaaagcgccgctcagattccccgccccatatatatgcggtggcggacaacgcctacaacgacatgctgcgcaaccgagacaaccagtccatgctgatcaccggagagtcgggggccggtaagacggttaacaccaagcgggtcattcagtactttgccatcgtcgctgccctgggagacgggccgggcaagaaggcccaatttctggcaacaaagacggggggcacccttgaggatcaaatcatcgaggccaaccctgccatggaggcctttggcaacgccaagaccctgaggaatgataactcctcccgctttggcaagttcatccgcattcactttggtccctctgggaagctggcatccgcggatattgacagctatctcctggagaagtcgcgggtgatcttccagttgcctggtgagcgcagctaccatgtctactaccagatcctctcagggaggaagccagagctgcaggacatgctgcttctgtctatgaacccctatgactaccacttctgcagccagggcgtcatcaccgtggacaacatgaatgatggggaggagctcatcgccaccgaccatgccatggacatcctaggcttcagcgtggatgagaaatgtgcctgctataagatcgtgggcgccctcctgcactttggcaacatgaagttcaagcagaagcagcgggaggagcaggcggaggccgatggcactgagagtgctgacaaggctgcctacctgatgggggtcagcagtggggacctcctcaaaggccttttgcacccccgggtgcgtgtagggaacgagtacgtgaccaagggccagagtgtggagcaggtggtgtttgctgtgggggctctggccaaggccacctatgaccggctgttcaggtggctggtgtctcggatcaaccagaccctggacacaaagctgccccggcagttcttcatcggggttctggacatcgctgggtttgagatctttgagttcaacagcttcgaacagctgtgcatcaacttcaccaatgagaaattgcagcagttcttcaaccagcacatgtttgtgctggagcaggaggagtacaagcgggagggcatcgactgggtcttcatcgacttcggccttgacctgcagccttgcatcgacctcatcgagaagccactgggcatcctgtccatcctggaggaggaatgcatgttccccaaggcctcagacgccagcttccgggccaagctctacgacaaccacgcggggaagtcacccaatttccagcagcctcggcctgacaagaagcgcaagtaccaggcccacttcgaggtggtccactacgcaggcgtggtgccttacagcattgtgggctggctggagaaaaacaaggatcccctgaatgagaccgtggtccccatcttccagaagtcacagaataggctcctggcgactctctatgagaattatgcgggctcctgctccactgagccccccaagtctggggtgaaagagaagcgtaagaaggcagcatcgttccagacggtgtcccagctgcacaaggagaacctcaacaagctgatgaccaacctgcgggccacacagccccacttcgtccgctgcattgtccccaacgagaacaaaaccccaggggtcatggatgccttcttggtgctacaccagctgcgctgcaatggggtcctggaggggatccggatctgccgccaagggttccccaacaggttgctctacaccgacttccggcagcggtaccgtatcctgaaccccagtgccatcccggatgacaccttcatggacagcaggaaggccacagagaaactgctgggctcgctggacttggatcacacccagtaccagtttggccacaccaaggtgttcttcaaggctgggcttctaggcgtcctggaagagctccgtgaccagcgcctggccaaggtgctgacgctgctgcaggcgcggagccgtggccgcctcatgcgccttgagtaccagcgcctgctgggaggcagggatgcgctgttcaccatccagtggaacatccgtgccttcaatgccgtcaagaactggtcatggatgaagctctttttcaagatgaagccgctgctgcgctcggcgcaggctgaggaggagctggcggccctgcgggcagagctgcgggggttgcgaggggcgctggctgcggccgaggccaagcgccaggaactggaggagacgcacgtcagcatcacccaggagaagaatgacctggccctgcagctgcaggctgagcaggacaacctggcagatgccgaggagcgctgccacttgctgatcaagtccaaggtgcagctggaggggaaggtgaaggagctgagtgagcggctggaggatgaggaggaggtgaacgctgacctggccgcccgccggcgcaagctggaggacgagtgcacggagctcaagaaggacattgatgacctggagctgacactggccaaagctgagaaggagaagcaagccactgagaacaaggtgaagaacctgacggaagagatggctgcgctggacgagtcagtggcccggctgaccaaggagaagaaggcgttgcaggaggcccaccaacaggccctgggtgacctgcaggccgaggaggaccgtgtgagcgcgctgaccaaggccaagctccggctggagcaacaggtggaggacctggaatgctccctggagcaggagaagaagctgcgcatggacacggagcgggccaagcgcaagctggagggtgacctgaagctgacgcaggagtcggtggctgatgctgctcaagacaagcagcagctggaggagaagctcaagaagaaggactccgagctgagccagctgagcctgcgggtggaagacgagcagctcttgggggcccagatgcagaagaagatcaaggagctgcaggctcgggcggaggagctggaagaggagctggaggcagagcgggcagcccgggcccgcgtggagaagcagcgtgcagaggcggcgcgggagctggaggagctgagcgagcggctggaggaggcaggcggcgcatccgcggggcagcgcgagggctgccgcaagcgggaggcggagctggggaggctgcggcgggagctggaggaggcggcgctgcggcacgaggccacagtggcggcactgcggcgcaagcaggcggagggcgcggcggagctgggggagcaggtggacagcctgcagcgggtgcggcagaagctggagaaggagaagagtgagctgcgcatggaggtggacgacctggctgccaacgtggagactctgacccgcgccaaggccagtgcagagaagctgtgccggacctatgaggatcagctaagcgaggccaagatcaaggtggaggagctgcagcggcagctggcggacgcaagcacgcagcgtgggcgactacagacggaaagcggggagctgagtcgcctgctagaggagaaggagtgtctgatcagtcagctgagccgtggaaaggccctggccgcccaaagcctggaagagttgcggcgccagctagaggaggaaagcaaggccaagagtgccctggcccacgccgtgcaggctctgcggcacgactgtgacctcctgcgggagcaacacgaggaggaggctgaggcccaggctgagctgcagcggctgctgtccaaggccaatgccgaggtggcccagtggaggagcaagtacgaagcagatgccatccagaggaccgaggagctggaggaggccaaaaaaaagctggcactgcggctgcaggaggcagaggagggcgtggaggctgccaacgccaagtgctcatcgttggagaaggccaagctgcggctacagacagagtcagaggatgtaaccctggagctggagcgggcgacctcagcagctgctgcgctggacaagaagcagcggcacttggaacgggcactggaggaacggcggcggcaggaggaggagatgcagcgggagctggaggcggcacagagggagtcccgtggcctgggcaccgagctcttccggctgcggcacggccacgaggaggcacttgaagccctggagacgctcaagcgggagaacaagaacctgcaggaggagatcagcgacctcacagaccaggtgagtctcagtgggaagagcatccaggaactggagaaaaccaagaaggcgctggaaggcgagaagagtgagatccaggctgcactggaggaggcagagggggccctggagctggaggagaccaagacgctgcggatccagctggagctctcccaggtcaaagcagaagtggaccggaagctggcagagaaagacgaggagtgcgctaacctgaggcgcaaccaccagcgagctgtggagtccctgcaggcctccctggatgcagagacacgggcccgcaatgaggcgctgcggctcaagaagaagatggagggtgacctcaacgacctggagctgcagctgggccatgccacccgtcaggccacagaggcccaggctgccacgcggctgatgcaggcacagctcaaggaggagcaggcagggcgggacgaggagcagcggctggcagctgagctccacgagcaggcgcaggctctggagcgccgggcctcgctgctggctgcggagctggaggagctgcgggctgccctggagcagggcgagcgcagccggcgactggcagagcaggagcttttggaggccaccgagcgcctcaaccttctgcattcgcagaacacaggcctcctaaaccagaagaagaagctggaggcggacttggcccagctgagcggggaggtggaggaggctgcacaggagaggcgggaggctgaggagaaggccaaaaaggccatcactgatgcggccatgatggccgaggagctgaagaaggagcaggacacaagtgcacacctggaacggatgaagaagacgctggagcagacggtgcgcgagctccaggcccgccttgaggaggcagaacaggccgccctccgtggcgggaagaagcaggtgcagaagctggaggccaaggtacgggagctggaggctgagcttgatgcagagcagaagaagcacgccgaggcccttaagggcgtgcgcaagcatgagcgccgtgtcaaggagctcgcataccaggccgaggaggacaggaagaacctggctcgcatgcaggacctggtggacaagctgcagagcaaggtcaagagctacaagcgccagtttgaggaggcggagcagcaggccaacaccaacctggccaagtatcgcaaggcccagcacgagctggatgatgcggaggagcgggcagacatggcggaaacccaggccaacaagctgcgggcacggacccgggacgccctgggccccaagcacaaggagtgacggcctgaccccctgggctctaaagaggaatgtctgctgttgcacatctggctgaggccacctgccccgatcctgccatctctgcatcgccccctgctgccttcagccttccctgggccctgaataaacaccacagccagtttccttctcattcttttctttggggttcaggaggaaaaacacagtcctagggacaaaagccaggtccacagcagtcatttttaaaataaagttatttaatagtctccaaaaaaaaaaaaaaaaaaa

SEQ ID NO: 7 - DNA, 14 bp, Homo sapiens
gttcatgggctgca

SEQ ID NO: 8 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged thymidine
  MOD_RES (3)..(3): May be a 2 prime O, 4 prime C methylene bridged thymidine
  MOD_RES (12)..(12): May be a 2 prime O, 4 prime C methylene bridged guanosine
  MOD_RES (13)..(13): May be a 2 prime O, 4 prime C methylene bridged cytidine
  MOD_RES (14)..(14): May be a 2 prime O, 4 prime C methylene bridged adenosine
gttcatgggctgca

SEQ ID NO: 9 - DNA, 14 bp, Homo sapiens
ggttcatgggctgc

SEQ ID NO: 10 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged guanosine
  MOD_RES (3)..(3): May be a 2 prime O, 4 prime C methylene bridged thymidine
  MOD_RES (12)..(12): May be a 2 prime O, 4 prime C methylene bridged thymidine
  MOD_RES (13)..(13): May be a 2 prime O, 4 prime C methylene bridged guanosine
  MOD_RES (14)..(14): May be a 2 prime O, 4 prime C methylene bridged cytidine
ggttcatgggctgc

SEQ ID NO: 11 - DNA, 14 bp, Homo sapiens
gggttcatgggctg

SEQ ID NO: 12 - DNA, 14 bp, Artificial Sequence
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged guanosine
  MOD_RES (3)..(3): May be a 2 prime O, 4 prime C methylene bridged guanosine
  MOD_RES (12)..(12): May be a 2 prime O, 4 prime C methylene bridged cytidine
  MOD_RES (13)..(13): May be a 2 prime O, 4 prime C methylene bridged thymidine
  MOD_RES (14)..(14): May be a 2 prime O, 4 prime C methylene bridged guanosine
  modified nucleotide MYHB7B antisense oligonucleotide
gggttcatgggctg

SEQ ID NO: 13 - DNA, 14 bp, Homo sapiens
atggtgacacagaa

SEQ ID NO: 14 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged thymidine
  MOD_RES (3)..(3): May be a 2 prime O, 4 prime C methylene bridged guanosine
  MOD_RES (12)..(12): May be a 2 prime O, 4 prime C methylene bridged guanosine
  MOD_RES (13)..(13): May be a 2 prime O, 4 prime C methylene bridged adenosine
  MOD_RES (14)..(14): May be a 2 prime O, 4 prime C methylene bridged adenosine
atggtgacacagaa

SEQ ID NO: 15 - DNA, 14 bp, Homo sapiens
atcagcatggactg

SEQ ID NO: 16 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged thymidine
  MOD_RES (3)..(3): May be a 2 prime O, 4 prime C methylene bridged cytidine
  MOD_RES (12)..(12): May be a 2 prime O, 4 prime C methylene bridged cytidine
  MOD_RES (13)..(13): May be a 2 prime O, 4 prime C methylene bridged thymidine
  MOD_RES (14)..(14): May be a 2 prime O, 4 prime C methylene bridged guanosine
atcagcatggactg

SEQ ID NO: 17 - DNA, 14 bp, Homo sapiens
gcttggtgttaacc

SEQ ID NO: 18 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged cytidine
  MOD_RES (3)..(3): May be a 2 prime O, 4 prime C methylene bridged thymidine
  MOD_RES (12)..(12): May be a 2 prime O, 4 prime C methylene bridged adenosine
  MOD_RES (13)..(13): May be a 2 prime O, 4 prime C methylene bridged cytidine
  MOD_RES (14)..(14): May be a 2 prime O, 4 prime C methylene bridged cytidine
gcttggtgttaacc

SEQ ID NO: 19 - DNA, 14 bp, Homo sapiens
tccatggcagggtt

SEQ ID NO: 20 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged cytidine
  MOD_RES (3)..(3): May be a 2 prime O, 4 prime C methylene bridged cytidine
  MOD_RES (12)..(12): May be a 2 prime O, 4 prime C methylene bridged guanosine
  MOD_RES (13)..(13): May be a 2 prime O, 4 prime C methylene bridged thymidine
  MOD_RES (14)..(14): May be a 2 prime O, 4 prime C methylene bridged thymidine
tccatggcagggtt

SEQ ID NO: 21 - DNA, 14 bp, Homo sapiens
ctccatggcagggt

SEQ ID NO: 22 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (2)..(2): May be a 2 prime O, 4 prime C methylene bridged thymidine
  MOD_RES (3)..(3): May be a 2 prime O, 4 prime C methylene bridged cytidine
  MOD_RES (12)..(12): May be a 2 prime O, 4 prime C methylene bridged guanosine
  MOD_RES (13)..(13): May be a 2 prime O, 4 prime C methylene bridged guanosine
  MOD_RES (14)..(14): May be a 2 prime O, 4 prime C methylene bridged thymidine
ctccatggcagggt

SEQ ID NO: 23 - DNA, 14 bp, Homo sapiens
cctccatggcaggg

SEQ ID NO: 24 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (2)..(2): May be a 2 prime O, 4 prime C methylene bridged cytidine
  MOD_RES (3)..(3): May be a 2 prime O, 4 prime C methylene bridged thymidine
  MOD_RES (12)..(12): May be a 2 prime O, 4 prime C methylene bridged guanosine
  MOD_RES (13)..(13): May be a 2 prime O, 4 prime C methylene bridged guanosine
  MOD_RES (14)..(14): May be a 2 prime O, 4 prime C methylene bridged guanosine
cctccatggcaggg

SEQ ID NO: 25 - DNA, 14 bp, Homo sapiens
gcctccatggcagg

SEQ ID NO: 26 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged cytidine
  MOD_RES (3)..(3): May be a 2 prime O, 4 prime C methylene bridged cytidine
  MOD_RES (12)..(12): May be a 2 prime O, 4 prime C methylene bridged adenosine
  MOD_RES (13)..(13): May be a 2 prime O, 4 prime C methylene bridged guanosine
  MOD_RES (14)..(14): May be a 2 prime O, 4 prime C methylene bridged guanosine
gcctccatggcagg

SEQ ID NO: 27 - DNA, 14 bp, Homo sapiens
agatagctgtcaat

SEQ ID NO: 28 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged guanosine
  MOD_RES (3)..(3): May be a 2 prime O, 4 prime C methylene bridged adenosine
  MOD_RES (12)..(12): May be a 2 prime O, 4 prime C methylene bridged adenosine
  MOD_RES (13)..(13): May be a 2 prime O, 4 prime C methylene bridged adenosine
  MOD_RES (14)..(14): May be a 2 prime O, 4 prime C methylene bridged thymidine
agatagctgtcaat

SEQ ID NO: 29 - DNA, 14 bp, Homo sapiens
gagatagctgtcaa

SEQ ID NO: 30 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged adenosine
  MOD_RES (3)..(3): May be a 2 prime O, 4 prime C methylene bridged guanosine
  MOD_RES (12)..(12): May be a 2 prime O, 4 prime C methylene bridged cytidine
  MOD_RES (13)..(13): May be a 2 prime O, 4 prime C methylene bridged adenosine
  MOD_RES (14)..(14): May be a 2 prime O, 4 prime C methylene bridged adenosine
gagatagctgtcaa

SEQ ID NO: 31 - DNA, 14 bp, Homo sapiens
ggagatagctgtca

SEQ ID NO: 32 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged guanosine
  MOD_RES (3)..(3): May be a 2 prime O, 4 prime C methylene bridged adenosine
  MOD_RES (12)..(12): May be a 2 prime O, 4 prime C methylene bridged thymidine
  MOD_RES (13)..(13): May be a 2 prime O, 4 prime C methylene bridged cytidine
  MOD_RES (14)..(14): May be a 2 prime O, 4 prime C methylene bridged adenosine
ggagatagctgtca

SEQ ID NO: 33 - DNA, 14 bp, Homo sapiens
aggagatagctgtc

SEQ ID NO: 34 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged guanosine
  MOD_RES (3)..(3): May be a 2 prime O, 4 prime C methylene bridged guanosine
  MOD_RES (12)..(12): May be a 2 prime O, 4 prime C methylene bridged guanosine
  MOD_RES (13)..(13): May be a 2 prime O, 4 prime C methylene bridged thymidine
  MOD_RES (14)..(14): May be a 2 prime O, 4 prime C methylene bridged cytidine
aggagatagctgtc

SEQ ID NO: 35 - DNA, 14 bp, Homo sapiens
caggagatagctgt

SEQ ID NO: 36 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (2)..(2): May be a 2 prime O, 4 prime C methylene bridged adenosine
  MOD_RES (3)..(3): May be a 2 prime O, 4 prime C methylene bridged guanosine
  MOD_RES (12)..(12): May be a 2 prime O, 4 prime C methylene bridged thymidine
  MOD_RES (13)..(13): May be a 2 prime O, 4 prime C methylene bridged guanosine
  MOD_RES (14)..(14): May be a 2 prime O, 4 prime C methylene bridged thymidine
caggagatagctgt

SEQ ID NO: 37 - DNA, 14 bp, Homo sapiens
ccaggagatagctg

SEQ ID NO: 38 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (2)..(2): May be a 2 prime O, 4 prime C methylene bridged cytidine
  MOD_RES (3)..(3): May be a 2 prime O, 4 prime C methylene bridged adenosine
  MOD_RES (12)..(12): May be a 2 prime O, 4 prime C methylene bridged cytidine
  MOD_RES (13)..(13): May be a 2 prime O, 4 prime C methylene bridged thymidine
  MOD_RES (14)..(14): May be a 2 prime O, 4 prime C methylene bridged guanosine
ccaggagatagctg

SEQ ID NO: 39 - DNA, 14 bp, Homo sapiens
tccaggagatagct

SEQ ID NO: 40 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged cytidine
  MOD_RES (3)..(3): May be a 2 prime O, 4 prime C methylene bridged cytidine
  MOD_RES (12)..(12): May be a 2 prime O, 4 prime C methylene bridged guanosine
  MOD_RES (13)..(13): May be a 2 prime O, 4 prime C methylene bridged cytidine
  MOD_RES (14)..(14): May be a 2 prime O, 4 prime C methylene bridged thymidine
tccaggagatagct

SEQ ID NO: 41 - DNA, 14 bp, Homo sapiens
cagaagtggtagtc

SEQ ID NO: 42 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (2)..(2): May be a 2 prime O, 4 prime C methylene bridged adenosine
  MOD_RES (3)..(3): May be a 2 prime O, 4 prime C methylene bridged guanosine
  MOD_RES (12)..(12): May be a 2 prime O, 4 prime C methylene bridged guanosine
  MOD_RES (13)..(13): May be a 2 prime O, 4 prime C methylene bridged thymidine
  MOD_RES (14)..(14): May be a 2 prime O, 4 prime C methylene bridged cytidine
cagaagtggtagtc

SEQ ID NO: 43 - DNA, 14 bp, Homo sapiens
tgcagaagtggtag

SEQ ID NO: 44 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged guanosine
  MOD_RES (3)..(3): May be a 2 prime O, 4 prime C methylene bridged cytidine
  MOD_RES (12)..(12): May be a 2 prime O, 4 prime C methylene bridged thymidine
  MOD_RES (13)..(13): May be a 2 prime O, 4 prime C methylene bridged adenosine
  MOD_RES (14)..(14): May be a 2 prime O, 4 prime C methylene bridged guanosine
tgcagaagtggtag

SEQ ID NO: 45 - DNA, 14 bp, Homo sapiens
ctgcagaagtggta

SEQ ID NO: 46 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (2)..(2): May be a 2 prime O, 4 prime C methylene bridged thymidine
  MOD_RES (3)..(3): May be a 2 prime O, 4 prime C methylene bridged guanosine
  MOD_RES (12)..(12): May be a 2 prime O, 4 prime C methylene bridged guanosine
  MOD_RES (13)..(13): May be a 2 prime O, 4 prime C methylene bridged thymidine
  MOD_RES (14)..(14): May be a 2 prime O, 4 prime C methylene bridged adenosine
ctgcagaagtggta

SEQ ID NO: 47 - DNA, 14 bp, Homo sapiens
gcactctcagtgcc

SEQ ID NO: 48 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged cytidine
  MOD_RES (3)..(3): May be a 2 prime O, 4 prime C methylene bridged adenosine
  MOD_RES (12)..(12): May be a 2 prime O, 4 prime C methylene bridged guanosine
  MOD_RES (13)..(13): May be a 2 prime O, 4 prime C methylene bridged cytidine
  MOD_RES (14)..(14): May be a 2 prime O, 4 prime C methylene bridged cytidine
gcactctcagtgcc

SEQ ID NO: 49 - DNA, 14 bp, Homo sapiens
taggcagccttgtc

SEQ ID NO: 50 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged adenosine
  MOD_RES (3)..(3): May be a 2 prime O, 4 prime C methylene bridged guanosine
  MOD_RES (12)..(12): May be a 2 prime O, 4 prime C methylene bridged guanosine
  MOD_RES (13)..(13): May be a 2 prime O, 4 prime C methylene bridged thymidine
  MOD_RES (14)..(14): May be a 2 prime O, 4 prime C methylene bridged cytidine
taggcagccttgtc

SEQ ID NO: 51 - DNA, 14 bp, Homo sapiens
acactctggccctt

SEQ ID NO: 52 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged cytidine
  MOD_RES (3)..(3): May be a 2 prime O, 4 prime C methylene bridged adenosine
  MOD_RES (12)..(12): May be a 2 prime O, 4 prime C methylene bridged cytidine
  MOD_RES (13)..(13): May be a 2 prime O, 4 prime C methylene bridged thymidine
  MOD_RES (14)..(14): May be a 2 prime O, 4 prime C methylene bridged thymidine
acactctggccctt

SEQ ID NO: 53 - DNA, 14 bp, Homo sapiens
tccacactctggcc

SEQ ID NO: 54 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged cytidine
  MOD_RES (3)..(3): May be a 2 prime O, 4 prime C methylene bridged cytidine
  MOD_RES (12)..(12): May be a 2 prime O, 4 prime C methylene bridged guanosine
  MOD_RES (13)..(13): May be a 2 prime O, 4 prime C methylene bridged cytidine
  MOD_RES (14)..(14): May be a 2 prime O, 4 prime C methylene bridged cytidine
tccacactctggcc

SEQ ID NO: 55 - DNA, 14 bp, Homo sapiens
ctccacactctggc

SEQ ID NO: 56 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (2)..(2): May be a 2 prime O, 4 prime C methylene bridged thymidine
  MOD_RES (3)..(3): May be a 2 prime O, 4 prime C methylene bridged cytidine
  MOD_RES (12)..(12): May be a 2 prime O, 4 prime C methylene bridged guanosine
  MOD_RES (13)..(13): May be a 2 prime O, 4 prime C methylene bridged guanosine
  MOD_RES (14)..(14): May be a 2 prime O, 4 prime C methylene bridged cytidine
ctccacactctggc

SEQ ID NO: 57 - DNA, 14 bp, Homo sapiens
gctccacactctgg

SEQ ID NO: 58 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged cytidine
  MOD_RES (3)..(3): May be a 2 prime O, 4 prime C methylene bridged thymidine
  MOD_RES (12)..(12): May be a 2 prime O, 4 prime C methylene bridged thymidine
  MOD_RES (13)..(13): May be a 2 prime O, 4 prime C methylene bridged guanosine
  MOD_RES (14)..(14): May be a 2 prime O, 4 prime C methylene bridged guanosine
gctccacactctgg

SEQ ID NO: 59 - DNA, 14 bp, Homo sapiens
tgctccacactctg

SEQ ID NO: 60 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged guanosine
  MOD_RES (3)..(3): May be a 2 prime O, 4 prime C methylene bridged cytidine
  MOD_RES (12)..(12): May be a 2 prime O, 4 prime C methylene bridged cytidine
  MOD_RES (13)..(13): May be a 2 prime O, 4 prime C methylene bridged thymidine
  MOD_RES (14)..(14): May be a 2 prime O, 4 prime C methylene bridged guanosine
tgctccacactctg

SEQ ID NO: 61 - DNA, 14 bp, Homo sapiens
acctgctccacact

SEQ ID NO: 62 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged cytidine
  MOD_RES (3)..(3): May be a 2 prime O, 4 prime C methylene bridged cytidine
  MOD_RES (12)..(12): May be a 2 prime O, 4 prime C methylene bridged adenosine
  MOD_RES (13)..(13): May be a 2 prime O, 4 prime C methylene bridged cytidine
  MOD_RES (14)..(14): May be a 2 prime O, 4 prime C methylene bridged thymidine
acctgctccacact

SEQ ID NO: 63 - DNA, 14 bp, Homo sapiens
ccacctgctccaca

SEQ ID NO: 64 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (2)..(2): May be a 2 prime O, 4 prime C methylene bridged cytidine
  MOD_RES (3)..(3): May be a 2 prime O, 4 prime C methylene bridged adenosine
  MOD_RES (12)..(12): May be a 2 prime O, 4 prime C methylene bridged adenosine
  MOD_RES (13)..(13): May be a 2 prime O, 4 prime C methylene bridged cytidine
  MOD_RES (14)..(14): May be a 2 prime O, 4 prime C methylene bridged adenosine
ccacctgctccaca

SEQ ID NO: 65 - DNA, 14 bp, Homo sapiens
accacctgctccac

SEQ ID NO: 66 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged cytidine
  MOD_RES (3)..(3): May be a 2 prime O, 4 prime C methylene bridged cytidine
  MOD_RES (12)..(12): May be a 2 prime O, 4 prime C methylene bridged cytidine
  MOD_RES (13)..(13): May be a 2 prime O, 4 prime C methylene bridged adenosine
  MOD_RES (14)..(14): May be a 2 prime O, 4 prime C methylene bridged cytidine
accacctgctccac

SEQ ID NO: 67 - DNA, 14 bp, Homo sapiens
ctcaaagatctcaa

SEQ ID NO: 68 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (2)..(2): May be a 2 prime O, 4 prime C methylene bridged thymidine
  MOD_RES (3)..(3): May be a 2 prime O, 4 prime C methylene bridged cytidine
  MOD_RES (12)..(12): May be a 2 prime O, 4 prime C methylene bridged cytidine
  MOD_RES (13)..(13): May be a 2 prime O, 4 prime C methylene bridged adenosine
  MOD_RES (14)..(14): May be a 2 prime O, 4 prime C methylene bridged adenosine
ctcaaagatctcaa

SEQ ID NO: 69 - DNA, 14 bp, Homo sapiens
actcaaagatctca

SEQ ID NO: 70 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged cytidine
  MOD_RES (3)..(3): May be a 2 prime O, 4 prime C methylene bridged thymidine
  MOD_RES (12)..(12): May be a 2 prime O, 4 prime C methylene bridged thymidine
  MOD_RES (13)..(13): May be a 2 prime O, 4 prime C methylene bridged cytidine
  MOD_RES (14)..(14): May be a 2 prime O, 4 prime C methylene bridged adenosine
actcaaagatctca

SEQ ID NO: 71 - DNA, 14 bp, Homo sapiens
aactcaaagatctc

SEQ ID NO: 72 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged adenosine
  MOD_RES (3)..(3): May be a 2 prime O, 4 prime C methylene bridged cytidine
  MOD_RES (12)..(12): May be a 2 prime O, 4 prime C methylene bridged cytidine
  MOD_RES (13)..(13): May be a 2 prime O, 4 prime C methylene bridged thymidine
  MOD_RES (14)..(14): May be a 2 prime O, 4 prime C methylene bridged cytidine
aactcaaagatctc

SEQ ID NO: 73 - DNA, 14 bp, Homo sapiens
atgaagacccagtc

SEQ ID NO: 74 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged thymidine
  MOD_RES (3)..(3): May be a 2 prime O, 4 prime C methylene bridged guanosine
  MOD_RES (12)..(12): May be a 2 prime O, 4 prime C methylene bridged guanosine
  MOD_RES (13)..(13): May be a 2 prime O, 4 prime C methylene bridged thymidine
  MOD_RES (14)..(14): May be a 2 prime O, 4 prime C methylene bridged cytidine
atgaagacccagtc

SEQ ID NO: 75 - DNA, 14 bp, Homo sapiens
gatgaagacccagt

SEQ ID NO: 76 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged adenosine
  MOD_RES (3)..(3): May be a 2 prime O, 4 prime C methylene bridged thymidine
  MOD_RES (12)..(12): May be a 2 prime O, 4 prime C methylene bridged adenosine
  MOD_RES (13)..(13): May be a 2 prime O, 4 prime C methylene bridged guanosine
  MOD_RES (14)..(14): May be a 2 prime O, 4 prime C methylene bridged thymidine
gatgaagacccagt

SEQ ID NO: 77 - DNA, 14 bp, Homo sapiens
tagtggaccacctc

SEQ ID NO: 78 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged adenosine
  MOD_RES (3)..(3): May be a 2 prime O, 4 prime C methylene bridged guanosine
  MOD_RES (12)..(12): May be a 2 prime O, 4 prime C methylene bridged cytidine
  MOD_RES (13)..(13): May be a 2 prime O, 4 prime C methylene bridged thymidine
  MOD_RES (14)..(14): May be a 2 prime O, 4 prime C methylene bridged cytidine
tagtggaccacctc

SEQ ID NO: 79 - DNA, 14 bp, Homo sapiens
aggttctccttgtg

SEQ ID NO: 80 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged guanosine
  MOD_RES (3)..(3): May be a 2 prime O, 4 prime C methylene bridged guanosine
  MOD_RES (12)..(12): May be a 2 prime O, 4 prime C methylene bridged guanosine
  MOD_RES (13)..(13): May be a 2 prime O, 4 prime C methylene bridged thymidine
  MOD_RES (14)..(14): May be a 2 prime O, 4 prime C methylene bridged guanosine
aggttctccttgtg

SEQ ID NO: 81 - DNA, 14 bp, Homo sapiens
gaggttctccttgt

SEQ ID NO: 82 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged adenosine
  MOD_RES (3)..(3): May be a 2 prime O, 4 prime C methylene bridged guanosine
  MOD_RES (12)..(12): May be a 2 prime O, 4 prime C methylene bridged thymidine
  MOD_RES (13)..(13): May be a 2 prime O, 4 prime C methylene bridged guanosine
  MOD_RES (14)..(14): May be a 2 prime O, 4 prime C methylene bridged thymidine
gaggttctccttgt

SEQ ID NO: 83 - DNA, 14 bp, Homo sapiens
tgaggttctccttg

SEQ ID NO: 84 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged guanosine
  MOD_RES (3)..(3): May be a 2 prime O, 4 prime C methylene bridged adenosine
  MOD_RES (12)..(12): May be a 2 prime O, 4 prime C methylene bridged thymidine
  MOD_RES (13)..(13): May be a 2 prime O, 4 prime C methylene bridged thymidine
  MOD_RES (14)..(14): May be a 2 prime O, 4 prime C methylene bridged guanosine
tgaggttctccttg

SEQ ID NO: 85 - DNA, 14 bp, Homo sapiens
ttgaggttctcctt

SEQ ID NO: 86 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged thymidine
  MOD_RES (3)..(3): May be a 2 prime O, 4 prime C methylene bridged guanosine
  MOD_RES (12)..(12): May be a 2 prime O, 4 prime C methylene bridged cytidine
  MOD_RES (13)..(13): May be a 2 prime O, 4 prime C methylene bridged thymidine
  MOD_RES (14)..(14): May be a 2 prime O, 4 prime C methylene bridged thymidine
ttgaggttctcctt

SEQ ID NO: 87 - DNA, 14 bp, Homo sapiens
gttgaggttctcct

SEQ ID NO: 88 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged thymidine
  MOD_RES (3)..(3): May be a 2 prime O, 4 prime C methylene bridged thymidine
  MOD_RES (12)..(12): May be a 2 prime O, 4 prime C methylene bridged cytidine
  MOD_RES (13)..(13): May be a 2 prime O, 4 prime C methylene bridged cytidine
  MOD_RES (14)..(14): May be a 2 prime O, 4 prime C methylene bridged thymidine
gttgaggttctcct

SEQ ID NO: 89 - DNA, 14 bp, Homo sapiens
cttgttgaggttct

SEQ ID NO: 90 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (2)..(2): May be a 2 prime O, 4 prime C methylene bridged thymidine
  MOD_RES (3)..(3): May be a 2 prime O, 4 prime C methylene bridged thymidine
  MOD_RES (12)..(12): May be a 2 prime O, 4 prime C methylene bridged thymidine
  MOD_RES (13)..(13): May be a 2 prime O, 4 prime C methylene bridged cytidine
  MOD_RES (14)..(14): May be a 2 prime O, 4 prime C methylene bridged thymidine
cttgttgaggttct

SEQ ID NO: 91 - DNA, 14 bp, Homo sapiens
gggctgtgtggccc

SEQ ID NO: 92 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged guanosine
  MOD_RES (3)..(3): May be a 2 prime O, 4 prime C methylene bridged guanosine
  MOD_RES (12)..(12): May be a 2 prime O, 4 prime C methylene bridged cytidine
  MOD_RES (13)..(13): May be a 2 prime O, 4 prime C methylene bridged cytidine
  MOD_RES (14)..(14): May be a 2 prime O, 4 prime C methylene bridged cytidine
gggctgtgtggccc

SEQ ID NO: 93 - DNA, 14 bp, Homo sapiens
ccttcctgctgtcc

SEQ ID NO: 94 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (2)..(2): May be a 2 prime O, 4 prime C methylene bridged cytidine
  MOD_RES (3)..(3): May be a 2 prime O, 4 prime C methylene bridged thymidine
  MOD_RES (12)..(12): May be a 2 prime O, 4 prime C methylene bridged thymidine
  MOD_RES (13)..(13): May be a 2 prime O, 4 prime C methylene bridged cytidine
  MOD_RES (14)..(14): May be a 2 prime O, 4 prime C methylene bridged cytidine
ccttcctgctgtcc

SEQ ID NO: 95 - DNA, 14 bp, Homo sapiens
ggccttcctgctgt

SEQ ID NO: 96 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged guanosine
  MOD_RES (3)..(3): May be a 2 prime O, 4 prime C methylene bridged cytidine
  MOD_RES (12)..(12): May be a 2 prime O, 4 prime C methylene bridged thymidine
  MOD_RES (13)..(13): May be a 2 prime O, 4 prime C methylene bridged guanosine
  MOD_RES (14)..(14): May be a 2 prime O, 4 prime C methylene bridged thymidine
ggccttcctgctgt

SEQ ID NO: 97 - DNA, 14 bp, Homo sapiens
tggatggtgaacag

SEQ ID NO: 98 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged guanosine
  MOD_RES (3)..(3): May be a 2 prime O, 4 prime C methylene bridged guanosine
  MOD_RES (12)..(12): May be a 2 prime O, 4 prime C methylene bridged cytidine
  MOD_RES (13)..(13): May be a 2 prime O, 4 prime C methylene bridged adenosine
  MOD_RES (14)..(14): May be a 2 prime O, 4 prime C methylene bridged guanosine
tggatggtgaacag

SEQ ID NO: 99 - DNA, 14 bp, Homo sapiens
ctggatggtgaaca

SEQ ID NO: 100 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (2)..(2): May be a 2 prime O, 4 prime C methylene bridged thymidine
  MOD_RES (3)..(3): May be a 2 prime O, 4 prime C methylene bridged guanosine
  MOD_RES (12)..(12): May be a 2 prime O, 4 prime C methylene bridged adenosine
  MOD_RES (13)..(13): May be a 2 prime O, 4 prime C methylene bridged cytidine
  MOD_RES (14)..(14): May be a 2 prime O, 4 prime C methylene bridged adenosine
ctggatggtgaaca

SEQ ID NO: 101 - DNA, 14 bp, Homo sapiens
cactggatggtgaa

SEQ ID NO: 102 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (2)..(2): May be a 2 prime O, 4 prime C methylene bridged adenosine
  MOD_RES (3)..(3): May be a 2 prime O, 4 prime C methylene bridged cytidine
  MOD_RES (12)..(12): May be a 2 prime O, 4 prime C methylene bridged guanosine
  MOD_RES (13)..(13): May be a 2 prime O, 4 prime C methylene bridged adenosine
  MOD_RES (14)..(14): May be a 2 prime O, 4 prime C methylene bridged adenosine
cactggatggtgaa

SEQ ID NO: 103 - DNA, 14 bp, Homo sapiens
tccactggatggtg

SEQ ID NO: 104 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged cytidine
  MOD_RES (3)..(3): May be a 2 prime O, 4 prime C methylene bridged cytidine
  MOD_RES (12)..(12): May be a 2 prime O, 4 prime C methylene bridged guanosine
  MOD_RES (13)..(13): May be a 2 prime O, 4 prime C methylene bridged thymidine
  MOD_RES (14)..(14): May be a 2 prime O, 4 prime C methylene bridged guanosine
tccactggatggtg

SEQ ID NO: 105 - DNA, 14 bp, Homo sapiens
ttccactggatggt

SEQ ID NO: 106 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged thymidine
  MOD_RES (3)..(3): May be a 2 prime O, 4 prime C methylene bridged cytidine
  MOD_RES (12)..(12): May be a 2 prime O, 4 prime C methylene bridged guanosine
  MOD_RES (13)..(13): May be a 2 prime O, 4 prime C methylene bridged guanosine
  MOD_RES (14)..(14): May be a 2 prime O, 4 prime C methylene bridged thymidine
ttccactggatggt

SEQ ID NO: 107 - DNA, 14 bp, Homo sapiens
tgcagggccaggtc

SEQ ID NO: 108 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged guanosine
  MOD_RES (3)..(3): May be a 2 prime O, 4 prime C methylene bridged cytidine
  MOD_RES (12)..(12): May be a 2 prime O, 4 prime C methylene bridged guanosine
  MOD_RES (13)..(13): May be a 2 prime O, 4 prime C methylene bridged thymidine
  MOD_RES (14)..(14): May be a 2 prime O, 4 prime C methylene bridged cytidine
tgcagggccaggtc

SEQ ID NO: 109 - DNA, 14 bp, Homo sapiens
ctgcagggccaggt

SEQ ID NO: 110 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (2)..(2): May be a 2 prime O, 4 prime C methylene bridged thymidine
  MOD_RES (3)..(3): May be a 2 prime O, 4 prime C methylene bridged guanosine
  MOD_RES (12)..(12): May be a 2 prime O, 4 prime C methylene bridged guanosine
  MOD_RES (13)..(13): May be a 2 prime O, 4 prime C methylene bridged guanosine
  MOD_RES (14)..(14): May be a 2 prime O, 4 prime C methylene bridged thymidine
ctgcagggccaggt

SEQ ID NO: 111 - DNA, 14 bp, Homo sapiens
accttggacttgat

SEQ ID NO: 112 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged cytidine
  MOD_RES (3)..(3): May be a 2 prime O, 4 prime C methylene bridged cytidine
  MOD_RES (12)..(12): May be a 2 prime O, 4 prime C methylene bridged guanosine
  MOD_RES (13)..(13): May be a 2 prime O, 4 prime C methylene bridged adenosine
  MOD_RES (14)..(14): May be a 2 prime O, 4 prime C methylene bridged thymidine
accttggacttgat

SEQ ID NO: 113 - DNA, 14 bp, Homo sapiens
gcaccttggacttg

SEQ ID NO: 114 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged cytidine
  MOD_RES (3)..(3): May be a 2 prime O, 4 prime C methylene bridged adenosine
  MOD_RES (12)..(12): May be a 2 prime O, 4 prime C methylene bridged thymidine
  MOD_RES (13)..(13): May be a 2 prime O, 4 prime C methylene bridged thymidine
  MOD_RES (14)..(14): May be a 2 prime O, 4 prime C methylene bridged guanosine
gcaccttggacttg

SEQ ID NO: 115 - DNA, 14 bp, Homo sapiens
tgcaccttggactt

SEQ ID NO: 116 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged guanosine
  MOD_RES (3)..(3): May be a 2 prime O, 4 prime C methylene bridged cytidine
  MOD_RES (12)..(12): May be a 2 prime O, 4 prime C methylene bridged cytidine
  MOD_RES (13)..(13): May be a 2 prime O, 4 prime C methylene bridged thymidine
  MOD_RES (14)..(14): May be a 2 prime O, 4 prime C methylene bridged thymidine
tgcaccttggactt

SEQ ID NO: 117 - DNA, 14 bp, Homo sapiens
ctgcaccttggact

SEQ ID NO: 118 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (2)..(2): May be a 2 prime O, 4 prime C methylene bridged thymidine
  MOD_RES (3)..(3): May be a 2 prime O, 4 prime C methylene bridged guanosine
  MOD_RES (12)..(12): May be a 2 prime O, 4 prime C methylene bridged adenosine
  MOD_RES (13)..(13): May be a 2 prime O, 4 prime C methylene bridged cytidine
  MOD_RES (14)..(14): May be a 2 prime O, 4 prime C methylene bridged thymidine
ctgcaccttggact

SEQ ID NO: 119 - DNA, 14 bp, Homo sapiens
gctgcaccttggac

SEQ ID NO: 120 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged cytidine
  MOD_RES (3)..(3): May be a 2 prime O, 4 prime C methylene bridged thymidine
  MOD_RES (12)..(12): May be a 2 prime O, 4 prime C methylene bridged guanosine
  MOD_RES (13)..(13): May be a 2 prime O, 4 prime C methylene bridged adenosine
  MOD_RES (14)..(14): May be a 2 prime O, 4 prime C methylene bridged cytidine
gctgcaccttggac

SEQ ID NO: 121 - DNA, 14 bp, Homo sapiens
agctgcaccttgga

SEQ ID NO: 122 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged guanosine
  MOD_RES (3)..(3): May be a 2 prime O, 4 prime C methylene bridged cytidine
  MOD_RES (12)..(12): May be a 2 prime O, 4 prime C methylene bridged guanosine
  MOD_RES (13)..(13): May be a 2 prime O, 4 prime C methylene bridged guanosine
  MOD_RES (14)..(14): May be a 2 prime O, 4 prime C methylene bridged adenosine
agctgcaccttgga

SEQ ID NO: 123 - DNA, 14 bp, Homo sapiens
ctgcactggccttg

SEQ ID NO: 124 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (2)..(2): May be a 2 prime O, 4 prime C methylene bridged thymidine
  MOD_RES (3)..(3): May be a 2 prime O, 4 prime C methylene bridged guanosine
  MOD_RES (12)..(12): May be a 2 prime O, 4 prime C methylene bridged thymidine
  MOD_RES (13)..(13): May be a 2 prime O, 4 prime C methylene bridged thymidine
  MOD_RES (14)..(14): May be a 2 prime O, 4 prime C methylene bridged guanosine
ctgcactggccttg

SEQ ID NO: 125 - DNA, 14 bp, Homo sapiens
tctgcactggcctt

SEQ ID NO: 126 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged cytidine
  MOD_RES (3)..(3): May be a 2 prime O, 4 prime C methylene bridged thymidine
  MOD_RES (12)..(12): May be a 2 prime O, 4 prime C methylene bridged cytidine
  MOD_RES (13)..(13): May be a 2 prime O, 4 prime C methylene bridged thymidine
  MOD_RES (14)..(14): May be a 2 prime O, 4 prime C methylene bridged thymidine
tctgcactggcctt

SEQ ID NO: 127 - DNA, 14 bp, Homo sapiens
ctctgcactggcct

SEQ ID NO: 128 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (2)..(2): May be a 2 prime O, 4 prime C methylene bridged thymidine
  MOD_RES (3)..(3): May be a 2 prime O, 4 prime C methylene bridged cytidine
  MOD_RES (12)..(12): May be a 2 prime O, 4 prime C methylene bridged cytidine
  MOD_RES (13)..(13): May be a 2 prime O, 4 prime C methylene bridged cytidine
  MOD_RES (14)..(14): May be a 2 prime O, 4 prime C methylene bridged thymidine
ctctgcactggcct

SEQ ID NO: 129 - DNA, 14 bp, Homo sapiens
tctctgcactggcc

SEQ ID NO: 130 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged cytidine
  MOD_RES (3)..(3): May be a 2 prime O, 4 prime C methylene bridged thymidine
  MOD_RES (12)..(12): May be a 2 prime O, 4 prime C methylene bridged guanosine
  MOD_RES (13)..(13): May be a 2 prime O, 4 prime C methylene bridged cytidine
  MOD_RES (14)..(14): May be a 2 prime O, 4 prime C methylene bridged cytidine
tctctgcactggcc

SEQ ID NO: 131 - DNA, 14 bp, Homo sapiens
ttctctgcactggc

SEQ ID NO: 132 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged thymidine
  MOD_RES (3)..(3): May be a 2 prime O, 4 prime C methylene bridged cytidine
  MOD_RES (12)..(12): May be a 2 prime O, 4 prime C methylene bridged guanosine
  MOD_RES (13)..(13): May be a 2 prime O, 4 prime C methylene bridged guanosine
  MOD_RES (14)..(14): May be a 2 prime O, 4 prime C methylene bridged cytidine
ttctctgcactggc

SEQ ID NO: 133 - DNA, 14 bp, Homo sapiens
cttctctgcactgg

SEQ ID NO: 134 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (2)..(2): May be a 2 prime O, 4 prime C methylene bridged thymidine
  MOD_RES (3)..(3): May be a 2 prime O, 4 prime C methylene bridged thymidine
  MOD_RES (12)..(12): May be a 2 prime O, 4 prime C methylene bridged thymidine
  MOD_RES (13)..(13): May be a 2 prime O, 4 prime C methylene bridged guanosine
  MOD_RES (14)..(14): May be a 2 prime O, 4 prime C methylene bridged guanosine
cttctctgcactgg

SEQ ID NO: 135 - DNA, 14 bp, Homo sapiens
gcttctctgcactg

SEQ ID NO: 136 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged cytidine
  MOD_RES (3)..(3): May be a 2 prime O, 4 prime C methylene bridged thymidine
  MOD_RES (12)..(12): May be a 2 prime O, 4 prime C methylene bridged cytidine
  MOD_RES (13)..(13): May be a 2 prime O, 4 prime C methylene bridged thymidine
  MOD_RES (14)..(14): May be a 2 prime O, 4 prime C methylene bridged guanosine
gcttctctgcactg

SEQ ID NO: 137 - DNA, 14 bp, Homo sapiens
agcttctctgcact

SEQ ID NO: 138 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged guanosine
  MOD_RES (3)..(3): May be a 2 prime O, 4 prime C methylene bridged cytidine
  MOD_RES (12)..(12): May be a 2 prime O, 4 prime C methylene bridged adenosine
  MOD_RES (13)..(13): May be a 2 prime O, 4 prime C methylene bridged cytidine
  MOD_RES (14)..(14): May be a 2 prime O, 4 prime C methylene bridged thymidine
agcttctctgcact

SEQ ID NO: 139 - DNA, 14 bp, Homo sapiens
cagcttctctgcac

SEQ ID NO: 140 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (2)..(2): May be a 2 prime O, 4 prime C methylene bridged adenosine
  MOD_RES (3)..(3): May be a 2 prime O, 4 prime C methylene bridged guanosine
  MOD_RES (12)..(12): May be a 2 prime O, 4 prime C methylene bridged cytidine
  MOD_RES (13)..(13): May be a 2 prime O, 4 prime C methylene bridged adenosine
  MOD_RES (14)..(14): May be a 2 prime O, 4 prime C methylene bridged cytidine
cagcttctctgcac

SEQ ID NO: 141 - DNA, 14 bp, Homo sapiens
acagcttctctgca

SEQ ID NO: 142 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged cytidine
  MOD_RES (3)..(3): May be a 2 prime O, 4 prime C methylene bridged adenosine
  MOD_RES (12)..(12): May be a 2 prime O, 4 prime C methylene bridged guanosine
  MOD_RES (13)..(13): May be a 2 prime O, 4 prime C methylene bridged cytidine
  MOD_RES (14)..(14): May be a 2 prime O, 4 prime C methylene bridged adenosine
acagcttctctgca

SEQ ID NO: 143 - DNA, 14 bp, Homo sapiens
cacagcttctctgc

SEQ ID NO: 144 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (2)..(2): May be a 2 prime O, 4 prime C methylene bridged adenosine
  MOD_RES (3)..(3): May be a 2 prime O, 4 prime C methylene bridged cytidine
  MOD_RES (12)..(12): May be a 2 prime O, 4 prime C methylene bridged thymidine
  MOD_RES (13)..(13): May be a 2 prime O, 4 prime C methylene bridged guanosine
  MOD_RES (14)..(14): May be a 2 prime O, 4 prime C methylene bridged cytidine
cacagcttctctgc

SEQ ID NO: 145 - DNA, 14 bp, Homo sapiens
ttgatcttggcctc

SEQ ID NO: 146 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged thymidine
  MOD_RES (3)..(3): May be a 2 prime O, 4 prime C methylene bridged guanosine
  MOD_RES (12)..(12): May be a 2 prime O, 4 prime C methylene bridged cytidine
  MOD_RES (13)..(13): May be a 2 prime O, 4 prime C methylene bridged thymidine
  MOD_RES (14)..(14): May be a 2 prime O, 4 prime C methylene bridged cytidine
ttgatcttggcctc

SEQ ID NO: 147 - DNA, 14 bp, Homo sapiens
ctgcagctcctcca

SEQ ID NO: 148 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (2)..(2): May be a 2 prime O, 4 prime C methylene bridged thymidine
  MOD_RES (3)..(3): May be a 2 prime O, 4 prime C methylene bridged guanosine
  MOD_RES (12)..(12): May be a 2 prime O, 4 prime C methylene bridged cytidine
  MOD_RES (13)..(13): May be a 2 prime O, 4 prime C methylene bridged cytidine
  MOD_RES (14)..(14): May be a 2 prime O, 4 prime C methylene bridged adenosine
ctgcagctcctcca

SEQ ID NO: 149 - DNA, 14 bp, Homo sapiens
tgcctcctgcagcc

SEQ ID NO: 150 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged guanosine
  MOD_RES (3)..(3): May be a 2 prime O, 4 prime C methylene bridged cytidine
  MOD_RES (12)..(12): May be a 2 prime O, 4 prime C methylene bridged guanosine
  MOD_RES (13)..(13): May be a 2 prime O, 4 prime C methylene bridged cytidine
  MOD_RES (14)..(14): May be a 2 prime O, 4 prime C methylene bridged cytidine
tgcctcctgcagcc

SEQ ID NO: 151 - DNA, 14 bp, Homo sapiens
agcttggccttctc

SEQ ID NO: 152 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged guanosine
  MOD_RES (3)..(3): May be a 2 prime O, 4 prime C methylene bridged cytidine
  MOD_RES (12)..(12): May be a 2 prime O, 4 prime C methylene bridged cytidine
  MOD_RES (13)..(13): May be a 2 prime O, 4 prime C methylene bridged thymidine
  MOD_RES (14)..(14): May be a 2 prime O, 4 prime C methylene bridged cytidine
agcttggccttctc

SEQ ID NO: 153 - DNA, 14 bp, Homo sapiens
tctcctcctcctgc

SEQ ID NO: 154 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged cytidine
  MOD_RES (3)..(3): May be a 2 prime O, 4 prime C methylene bridged thymidine
  MOD_RES (12)..(12): May be a 2 prime O, 4 prime C methylene bridged thymidine
  MOD_RES (13)..(13): May be a 2 prime O, 4 prime C methylene bridged guanosine
  MOD_RES (14)..(14): May be a 2 prime O, 4 prime C methylene bridged cytidine
tctcctcctcctgc

SEQ ID NO: 155 - DNA, 14 bp, Homo sapiens
aggttcttcctgtc

SEQ ID NO: 156 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged guanosine
  MOD_RES (3)..(3): May be a 2 prime O, 4 prime C methylene bridged guanosine
  MOD_RES (12)..(12): May be a 2 prime O, 4 prime C methylene bridged guanosine
  MOD_RES (13)..(13): May be a 2 prime O, 4 prime C methylene bridged thymidine
  MOD_RES (14)..(14): May be a 2 prime O, 4 prime C methylene bridged cytidine
aggttcttcctgtc

SEQ ID NO: 157 - DNA, 14 bp, Homo sapiens
ccaggttcttcctg

SEQ ID NO: 158 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (2)..(2): May be a 2 prime O, 4 prime C methylene bridged cytidine
  MOD_RES (3)..(3): May be a 2 prime O, 4 prime C methylene bridged adenosine
  MOD_RES (12)..(12): May be a 2 prime O, 4 prime C methylene bridged cytidine
  MOD_RES (13)..(13): May be a 2 prime O, 4 prime C methylene bridged thymidine
  MOD_RES (14)..(14): May be a 2 prime O, 4 prime C methylene bridged guanosine
ccaggttcttcctg

SEQ ID NO: 159 - DNA, 14 bp, Homo sapiens
gccaggttcttcct

SEQ ID NO: 160 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged cytidine
  MOD_RES (3)..(3): May be a 2 prime O, 4 prime C methylene bridged cytidine
  MOD_RES (12)..(12): May be a 2 prime O, 4 prime C methylene bridged cytidine
  MOD_RES (13)..(13): May be a 2 prime O, 4 prime C methylene bridged cytidine
  MOD_RES (14)..(14): May be a 2 prime O, 4 prime C methylene bridged thymidine
gccaggttcttcct

SEQ ID NO: 161 - DNA, 14 bp, Homo sapiens
agccaggttcttcc

SEQ ID NO: 162 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged guanosine
  MOD_RES (3)..(3): May be a 2 prime O, 4 prime C methylene bridged cytidine
  MOD_RES (12)..(12): May be a 2 prime O, 4 prime C methylene bridged thymidine
  MOD_RES (13)..(13): May be a 2 prime O, 4 prime C methylene bridged cytidine
  MOD_RES (14)..(14): May be a 2 prime O, 4 prime C methylene bridged cytidine
agccaggttcttcc

SEQ ID NO: 163 - DNA, 14 bp, Homo sapiens
gagccaggttcttc

SEQ ID NO: 164 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged adenosine
  MOD_RES (3)..(3): May be a 2 prime O, 4 prime C methylene bridged guanosine
  MOD_RES (12)..(12): May be a 2 prime O, 4 prime C methylene bridged thymidine
  MOD_RES (13)..(13): May be a 2 prime O, 4 prime C methylene bridged thymidine
  MOD_RES (14)..(14): May be a 2 prime O, 4 prime C methylene bridged cytidine
gagccaggttcttc

SEQ ID NO: 165 - DNA, 14 bp, Homo sapiens
gaccttgctctgca

SEQ ID NO: 166 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged adenosine
  MOD_RES (3)..(3): May be a 2 prime O, 4 prime C methylene bridged cytidine
  MOD_RES (12)..(12): May be a 2 prime O, 4 prime C methylene bridged guanosine
  MOD_RES (13)..(13): May be a 2 prime O, 4 prime C methylene bridged cytidine
  MOD_RES (14)..(14): May be a 2 prime O, 4 prime C methylene bridged adenosine
gaccttgctctgca

SEQ ID NO: 167 - DNA, 14 bp, Homo sapiens
tgaccttgctctgc

SEQ ID NO: 168 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged guanosine
  MOD_RES (3)..(3): May be a 2 prime O, 4 prime C methylene bridged adenosine
  MOD_RES (12)..(12): May be a 2 prime O, 4 prime C methylene bridged thymidine
  MOD_RES (13)..(13): May be a 2 prime O, 4 prime C methylene bridged guanosine
  MOD_RES (14)..(14): May be a 2 prime O, 4 prime C methylene bridged cytidine
tgaccttgctctgc

SEQ ID NO: 169 - DNA, 14 bp, Homo sapiens
ttgaccttgctctg

SEQ ID NO: 170 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged thymidine
  MOD_RES (3)..(3): May be a 2 prime O, 4 prime C methylene bridged guanosine
  MOD_RES (12)..(12): May be a 2 prime O, 4 prime C methylene bridged cytidine
  MOD_RES (13)..(13): May be a 2 prime O, 4 prime C methylene bridged thymidine
  MOD_RES (14)..(14): May be a 2 prime O, 4 prime C methylene bridged guanosine
ttgaccttgctctg

SEQ ID NO: 171 - DNA, 14 bp, Homo sapiens
tcttgaccttgctc

SEQ ID NO: 172 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged cytidine
  MOD_RES (3)..(3): May be a 2 prime O, 4 prime C methylene bridged thymidine
  MOD_RES (12)..(12): May be a 2 prime O, 4 prime C methylene bridged cytidine
  MOD_RES (13)..(13): May be a 2 prime O, 4 prime C methylene bridged thymidine
  MOD_RES (14)..(14): May be a 2 prime O, 4 prime C methylene bridged cytidine
tcttgaccttgctc

SEQ ID NO: 173 - DNA, 14 bp, Homo sapiens
agctcttgaccttg

SEQ ID NO: 174 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged guanosine
  MOD_RES (3)..(3): May be a 2 prime O, 4 prime C methylene bridged cytidine
  MOD_RES (12)..(12): May be a 2 prime O, 4 prime C methylene bridged thymidine
  MOD_RES (13)..(13): May be a 2 prime O, 4 prime C methylene bridged thymidine
  MOD_RES (14)..(14): May be a 2 prime O, 4 prime C methylene bridged guanosine
agctcttgaccttg

SEQ ID NO: 175 - DNA, 14 bp, Homo sapiens
gtagctcttgacct

SEQ ID NO: 176 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged thymidine
  MOD_RES (3)..(3): May be a 2 prime O, 4 prime C methylene bridged adenosine
  MOD_RES (12)..(12): May be a 2 prime O, 4 prime C methylene bridged cytidine
  MOD_RES (13)..(13): May be a 2 prime O, 4 prime C methylene bridged cytidine
  MOD_RES (14)..(14): May be a 2 prime O, 4 prime C methylene bridged thymidine
gtagctcttgacct

SEQ ID NO: 177 - DNA, 14 bp, Homo sapiens
gtgctgggccttgc

SEQ ID NO: 178 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged thymidine
  MOD_RES (3)..(3): May be a 2 prime O, 4 prime C methylene bridged guanosine
  MOD_RES (12)..(12): May be a 2 prime O, 4 prime C methylene bridged thymidine
  MOD_RES (13)..(13): May be a 2 prime O, 4 prime C methylene bridged guanosine
  MOD_RES (14)..(14): May be a 2 prime O, 4 prime C methylene bridged cytidine
gtgctgggccttgc

SEQ ID NO: 179 - DNA, 14 bp, Homo sapiens
ttgttggcctgggt

SEQ ID NO: 180 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged thymidine
  MOD_RES (3)..(3): May be a 2 prime O, 4 prime C methylene bridged guanosine
  MOD_RES (12)..(12): May be a 2 prime O, 4 prime C methylene bridged guanosine
  MOD_RES (13)..(13): May be a 2 prime O, 4 prime C methylene bridged guanosine
  MOD_RES (14)..(14): May be a 2 prime O, 4 prime C methylene bridged thymidine
ttgttggcctgggt

SEQ ID NO: 181 - DNA, 14 bp, Homo sapiens
cagcttgttggcct

SEQ ID NO: 182 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (2)..(2): May be a 2 prime O, 4 prime C methylene bridged adenosine
  MOD_RES (3)..(3): May be a 2 prime O, 4 prime C methylene bridged guanosine
  MOD_RES (12)..(12): May be a 2 prime O, 4 prime C methylene bridged cytidine
  MOD_RES (13)..(13): May be a 2 prime O, 4 prime C methylene bridged cytidine
  MOD_RES (14)..(14): May be a 2 prime O, 4 prime C methylene bridged thymidine
cagcttgttggcct

SEQ ID NO: 183 - DNA, 14 bp, Homo sapiens
tcactcacatccat

SEQ ID NO: 184 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged cytidine
  MOD_RES (3)..(3): May be a 2 prime O, 4 prime C methylene bridged adenosine
  MOD_RES (4)..(4): May be a 2 prime O methyl deoxycytidine
  MOD_RES (6)..(6): May be a 2 prime O methyl deoxycytidine
  MOD_RES (8)..(8): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged adenosine
  MOD_RES (14)..(14): May be a 2 prime O, 4 prime C methylene bridged thymidine
tcactcacatccat

SEQ ID NO: 185 - DNA, 14 bp, Homo sapiens
ttcactcacatcca

SEQ ID NO: 186 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged thymidine
  MOD_RES (3)..(3): May be a 2 prime O, 4 prime C methylene bridged cytidine
  MOD_RES (5)..(5): May be a 2 prime O methyl deoxycytidine
  MOD_RES (7)..(7): May be a 2 prime O methyl deoxycytidine
  MOD_RES (9)..(9): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged cytidine
  MOD_RES (14)..(14): May be a 2 prime O, 4 prime C methylene bridged adenosine
ttcactcacatcca

SEQ ID NO: 187 - DNA, 14 bp, Homo sapiens
gttcactcacatcc

SEQ ID NO: 188 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged thymidine
  MOD_RES (3)..(3): May be a 2 prime O, 4 prime C methylene bridged thymidine
  MOD_RES (4)..(4): May be a 2 prime O methyl deoxycytidine
  MOD_RES (6)..(6): May be a 2 prime O methyl deoxycytidine
  MOD_RES (8)..(8): May be a 2 prime O methyl deoxycytidine
  MOD_RES (10)..(10): May be a 2 prime O methyl deoxycytidine
  MOD_RES (12)..(12): May be a 2 prime O, 4 prime C methylene bridged thymidine
  MOD_RES (13)..(13): May be a 2 prime O, 4 prime C methylene bridged cytidine
  MOD_RES (14)..(14): May be a 2 prime O, 4 prime C methylene bridged cytidine
gttcactcacatcc

SEQ ID NO: 189 - DNA, 14 bp, Homo sapiens
agttcactcacatc

SEQ ID NO: 190 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged guanosine
  MOD_RES (3)..(3): May be a 2 prime O, 4 prime C methylene bridged thymidine
  MOD_RES (5)..(5): May be a 2 prime O methyl deoxycytidine
  MOD_RES (7)..(7): May be a 2 prime O methyl deoxycytidine
  MOD_RES (9)..(9): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged adenosine
  MOD_RES (13)..(13): May be a 2 prime O, 4 prime C methylene bridged thymidine
  MOD_RES (14)..(14): May be a 2 prime O, 4 prime C methylene bridged cytidine
agttcactcacatc

SEQ ID NO: 191 - DNA, 14 bp, Homo sapiens
aagttcactcacat

SEQ ID NO: 192 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged adenosine
  MOD_RES (3)..(3): May be a 2 prime O, 4 prime C methylene bridged guanosine
  MOD_RES (6)..(6): May be a 2 prime O methyl deoxycytidine
  MOD_RES (8)..(8): May be a 2 prime O methyl deoxycytidine
  MOD_RES (10)..(10): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged adenosine
  MOD_RES (14)..(14): May be a 2 prime O, 4 prime C methylene bridged thymidine
aagttcactcacat

SEQ ID NO: 193 - DNA, 14 bp, Homo sapiens
caagttcactcaca

SEQ ID NO: 194 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (2)..(2): May be a 2 prime O, 4 prime C methylene bridged adenosine
  MOD_RES (3)..(3): May be a 2 prime O, 4 prime C methylene bridged adenosine
  MOD_RES (7)..(7): May be a 2 prime O methyl deoxycytidine
  MOD_RES (9)..(9): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged adenosine
  MOD_RES (13)..(13): May be a 2 prime O, 4 prime C methylene bridged cytidine
  MOD_RES (14)..(14): May be a 2 prime O, 4 prime C methylene bridged adenosine
caagttcactcaca

SEQ ID NO: 195 - DNA, 14 bp, Homo sapiens
ccaagttcactcac

SEQ ID NO: 196 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (2)..(2): May be a 2 prime O, 4 prime C methylene bridged cytidine
  MOD_RES (3)..(3): May be a 2 prime O, 4 prime C methylene bridged adenosine
  MOD_RES (8)..(8): May be a 2 prime O methyl deoxycytidine
  MOD_RES (10)..(10): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged adenosine
  MOD_RES (14)..(14): May be a 2 prime O, 4 prime C methylene bridged cytidine
ccaagttcactcac

SEQ ID NO: 197 - DNA, 14 bp, Homo sapiens
cccaagttcactca

SEQ ID NO: 198 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (2)..(2): May be a 2 prime O, 4 prime C methylene bridged cytidine
  MOD_RES (3)..(3): May be a 2 prime O, 4 prime C methylene bridged cytidine
  MOD_RES (9)..(9): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged thymidine
  MOD_RES (13)..(13): May be a 2 prime O, 4 prime C methylene bridged cytidine
  MOD_RES (14)..(14): May be a 2 prime O, 4 prime C methylene bridged adenosine
cccaagttcactca

SEQ ID NO: 199 - DNA, 14 bp, Homo sapiens
ccccaagttcactc

SEQ ID NO: 200 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (2)..(2): May be a 2 prime O, 4 prime C methylene bridged cytidine
  MOD_RES (3)..(3): May be a 2 prime O, 4 prime C methylene bridged cytidine
  MOD_RES (4)..(4): May be a 2 prime O methyl deoxycytidine
  MOD_RES (10)..(10): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged thymidine
  MOD_RES (14)..(14): May be a 2 prime O, 4 prime C methylene bridged cytidine
ccccaagttcactc

SEQ ID NO: 201 - DNA, 14 bp, Homo sapiens
tccccaagttcact

SEQ ID NO: 202 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged cytidine
  MOD_RES (3)..(3): May be a 2 prime O, 4 prime C methylene bridged cytidine
  MOD_RES (4)..(4): May be a 2 prime O methyl deoxycytidine
  MOD_RES (5)..(5): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged adenosine
  MOD_RES (13)..(13): May be a 2 prime O, 4 prime C methylene bridged cytidine
  MOD_RES (14)..(14): May be a 2 prime O, 4 prime C methylene bridged thymidine
tccccaagttcact

SEQ ID NO: 203 - DNA, 14 bp, Homo sapiens
ctccccaagttcac

SEQ ID NO: 204 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (2)..(2): May be a 2 prime O, 4 prime C methylene bridged thymidine
  MOD_RES (3)..(3): May be a 2 prime O, 4 prime C methylene bridged cytidine
  MOD_RES (4)..(4): May be a 2 prime O methyl deoxycytidine
  MOD_RES (5)..(5): May be a 2 prime O methyl deoxycytidine
  MOD_RES (6)..(6): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged adenosine
  MOD_RES (14)..(14): May be a 2 prime O, 4 prime C methylene bridged cytidine
ctccccaagttcac

SEQ ID NO: 205 - DNA, 14 bp, Homo sapiens
actccccaagttca

SEQ ID NO: 206 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged cytidine
  MOD_RES (3)..(3): May be a 2 prime O, 4 prime C methylene bridged thymidine
  MOD_RES (4)..(4): May be a 2 prime O methyl deoxycytidine
  MOD_RES (5)..(5): May be a 2 prime O methyl deoxycytidine
  MOD_RES (6)..(6): May be a 2 prime O methyl deoxycytidine
  MOD_RES (7)..(7): May be a 2 prime O methyl deoxycytidine
  MOD_RES (12)..(12): May be a 2 prime O, 4 prime C methylene bridged thymidine
  MOD_RES (13)..(13): May be a 2 prime O, 4 prime C methylene bridged cytidine
  MOD_RES (14)..(14): May be a 2 prime O, 4 prime C methylene bridged adenosine
actccccaagttca

SEQ ID NO: 207 - DNA, 14 bp, Homo sapiens
gactccccaagttc

SEQ ID NO: 208 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged adenosine
  MOD_RES (3)..(3): May be a 2 prime O, 4 prime C methylene bridged cytidine
  MOD_RES (5)..(5): May be a 2 prime O methyl deoxycytidine
  MOD_RES (6)..(6): May be a 2 prime O methyl deoxycytidine
  MOD_RES (7)..(7): May be a 2 prime O methyl deoxycytidine
  MOD_RES (8)..(8): May be a 2 prime O methyl deoxycytidine
  MOD_RES (12)..(12): May be a 2 prime O, 4 prime C methylene bridged thymidine
  MOD_RES (13)..(13): May be a 2 prime O, 4 prime C methylene bridged thymidine
  MOD_RES (14)..(14): May be a 2 prime O, 4 prime C methylene bridged cytidine
gactccccaagttc

SEQ ID NO: 209 - DNA, 14 bp, Homo sapiens
agactccccaagtt

SEQ ID NO: 210 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged guanosine
  MOD_RES (3)..(3): May be a 2 prime O, 4 prime C methylene bridged adenosine
  MOD_RES (4)..(4): May be a 2 prime O methyl deoxycytidine
  MOD_RES (6)..(6): May be a 2 prime O methyl deoxycytidine
  MOD_RES (7)..(7): May be a 2 prime O methyl deoxycytidine
  MOD_RES (8)..(8): May be a 2 prime O methyl deoxycytidine
  MOD_RES (9)..(9): May be a 2 prime O methyl deoxycytidine
  MOD_RES (12)..(12): May be a 2 prime O, 4 prime C methylene bridged guanosine
  MOD_RES (13)..(13): May be a 2 prime O, 4 prime C methylene bridged thymidine
  MOD_RES (14)..(14): May be a 2 prime O, 4 prime C methylene bridged thymidine
agactccccaagtt

SEQ ID NO: 211 - DNA, 14 bp, Homo sapiens
cagactccccaagt

SEQ ID NO: 212 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (2)..(2): May be a 2 prime O, 4 prime C methylene bridged adenosine
  MOD_RES (3)..(3): May be a 2 prime O, 4 prime C methylene bridged guanosine
  MOD_RES (5)..(5): May be a 2 prime O methyl deoxycytidine
  MOD_RES (7)..(7): May be a 2 prime O methyl deoxycytidine
  MOD_RES (8)..(8): May be a 2 prime O methyl deoxycytidine
  MOD_RES (9)..(9): May be a 2 prime O methyl deoxycytidine
  MOD_RES (10)..(10): May be a 2 prime O methyl deoxycytidine
  MOD_RES (12)..(12): May be a 2 prime O, 4 prime C methylene bridged adenosine
  MOD_RES (13)..(13): May be a 2 prime O, 4 prime C methylene bridged guanosine
  MOD_RES (14)..(14): May be a 2 prime O, 4 prime C methylene bridged thymidine
cagactccccaagt

SEQ ID NO: 213 - DNA, 14 bp, Homo sapiens
gcagactccccaag

SEQ ID NO: 214 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged cytidine
  MOD_RES (3)..(3): May be a 2 prime O, 4 prime C methylene bridged adenosine
  MOD_RES (6)..(6): May be a 2 prime O methyl deoxycytidine
  MOD_RES (8)..(8): May be a 2 prime O methyl deoxycytidine
  MOD_RES (9)..(9): May be a 2 prime O methyl deoxycytidine
  MOD_RES (10)..(10): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged adenosine
  MOD_RES (13)..(13): May be a 2 prime O, 4 prime C methylene bridged adenosine
  MOD_RES (14)..(14): May be a 2 prime O, 4 prime C methylene bridged guanosine
gcagactccccaag

SEQ ID NO: 215 - DNA, 14 bp, Homo sapiens
aggcacccagactc

SEQ ID NO: 216 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged guanosine
  MOD_RES (3)..(3): May be a 2 prime O, 4 prime C methylene bridged guanosine
  MOD_RES (4)..(4): May be a 2 prime O methyl deoxycytidine
  MOD_RES (6)..(6): May be a 2 prime O methyl deoxycytidine
  MOD_RES (7)..(7): May be a 2 prime O methyl deoxycytidine
  MOD_RES (8)..(8): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged thymidine
  MOD_RES (14)..(14): May be a 2 prime O, 4 prime C methylene bridged cytidine
aggcacccagactc

SEQ ID NO: 217 - DNA, 14 bp, Homo sapiens
caggcacccagact

SEQ ID NO: 218 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (2)..(2): May be a 2 prime O, 4 prime C methylene bridged adenosine
  MOD_RES (3)..(3): May be a 2 prime O, 4 prime C methylene bridged guanosine
  MOD_RES (5)..(5): May be a 2 prime O methyl deoxycytidine
  MOD_RES (7)..(7): May be a 2 prime O methyl deoxycytidine
  MOD_RES (8)..(8): May be a 2 prime O methyl deoxycytidine
  MOD_RES (9)..(9): May be a 2 prime O methyl deoxycytidine
  MOD_RES (12)..(12): May be a 2 prime O, 4 prime C methylene bridged adenosine
  MOD_RES (13)..(13): May be a 2 prime O, 4 prime C methylene bridged cytidine
  MOD_RES (14)..(14): May be a 2 prime O, 4 prime C methylene bridged thymidine
caggcacccagact

SEQ ID NO: 219 - DNA, 14 bp, Homo sapiens
tcaggcacccagac

SEQ ID NO: 220 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged cytidine
  MOD_RES (3)..(3): May be a 2 prime O, 4 prime C methylene bridged adenosine
  MOD_RES (6)..(6): May be a 2 prime O methyl deoxycytidine
  MOD_RES (8)..(8): May be a 2 prime O methyl deoxycytidine
  MOD_RES (9)..(9): May be a 2 prime O methyl deoxycytidine
  MOD_RES (10)..(10): May be a 2 prime O methyl deoxycytidine
  MOD_RES (12)..(12): May be a 2 prime O, 4 prime C methylene bridged guanosine
  MOD_RES (13)..(13): May be a 2 prime O, 4 prime C methylene bridged adenosine
  MOD_RES (14)..(14): May be a 2 prime O, 4 prime C methylene bridged cytidine
tcaggcacccagac

SEQ ID NO: 221 - DNA, 14 bp, Homo sapiens
atcaggcacccaga

SEQ ID NO: 222 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged thymidine
  MOD_RES (3)..(3): May be a 2 prime O, 4 prime C methylene bridged cytidine
  MOD_RES (7)..(7): May be a 2 prime O methyl deoxycytidine
  MOD_RES (9)..(9): May be a 2 prime O methyl deoxycytidine
  MOD_RES (10)..(10): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged adenosine
  MOD_RES (13)..(13): May be a 2 prime O, 4 prime C methylene bridged guanosine
  MOD_RES (14)..(14): May be a 2 prime O, 4 prime C methylene bridged adenosine
atcaggcacccaga

SEQ ID NO: 223 - DNA, 14 bp, Homo sapiens
gctgcagaagtggt

SEQ ID NO: 224 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged cytidine
  MOD_RES (3)..(3): May be a 2 prime O, 4 prime C methylene bridged thymidine
  MOD_RES (5)..(5): May be a 2 prime O methyl deoxycytidine
  MOD_RES (12)..(12): May be a 2 prime O, 4 prime C methylene bridged guanosine
  MOD_RES (13)..(13): May be a 2 prime O, 4 prime C methylene bridged guanosine
  MOD_RES (14)..(14): May be a 2 prime O, 4 prime C methylene bridged thymidine
gctgcagaagtggt

SEQ ID NO: 225 - DNA, 14 bp, Homo sapiens
atgtccatggcatg

SEQ ID NO: 226 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged thymidine
  MOD_RES (3)..(3): May be a 2 prime O, 4 prime C methylene bridged guanosine
  MOD_RES (5)..(5): May be a 2 prime O methyl deoxycytidine
  MOD_RES (6)..(6): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged adenosine
  MOD_RES (13)..(13): May be a 2 prime O, 4 prime C methylene bridged thymidine
  MOD_RES (14)..(14): May be a 2 prime O, 4 prime C methylene bridged guanosine
atgtccatggcatg

SEQ ID NO: 227 - DNA, 14 bp, Homo sapiens
atcttatagcaggc

SEQ ID NO: 228 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged thymidine
  MOD_RES (3)..(3): May be a 2 prime O, 4 prime C methylene bridged cytidine
  MOD_RES (10)..(10): May be a 2 prime O methyl deoxycytidine
  MOD_RES (12)..(12): May be a 2 prime O, 4 prime C methylene bridged guanosine
  MOD_RES (13)..(13): May be a 2 prime O, 4 prime C methylene bridged guanosine
  MOD_RES (14)..(14): May be a 2 prime O, 4 prime C methylene bridged cytidine
atcttatagcaggc

SEQ ID NO: 229 - DNA, 14 bp, Homo sapiens
actctcagtgccat

SEQ ID NO: 230 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged cytidine
  MOD_RES (3)..(3): May be a 2 prime O, 4 prime C methylene bridged thymidine
  MOD_RES (4)..(4): May be a 2 prime O methyl deoxycytidine
  MOD_RES (6)..(6): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged adenosine
  MOD_RES (14)..(14): May be a 2 prime O, 4 prime C methylene bridged thymidine
actctcagtgccat

SEQ ID NO: 231 - DNA, 14 bp, Homo sapiens
cactctcagtgcca

SEQ ID NO: 232 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (2)..(2): May be a 2 prime O, 4 prime C methylene bridged adenosine
  MOD_RES (3)..(3): May be a 2 prime O, 4 prime C methylene bridged cytidine
  MOD_RES (5)..(5): May be a 2 prime O methyl deoxycytidine
  MOD_RES (7)..(7): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged cytidine
  MOD_RES (14)..(14): May be a 2 prime O, 4 prime C methylene bridged adenosine
cactctcagtgcca

SEQ ID NO: 233 - DNA, 14 bp, Homo sapiens
agcactctcagtgc

SEQ ID NO: 234 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged guanosine
  MOD_RES (3)..(3): May be a 2 prime O, 4 prime C methylene bridged cytidine
  MOD_RES (5)..(5): May be a 2 prime O methyl deoxycytidine
  MOD_RES (7)..(7): May be a 2 prime O methyl deoxycytidine
  MOD_RES (9)..(9): May be a 2 prime O methyl deoxycytidine
  MOD_RES (12)..(12): May be a 2 prime O, 4 prime C methylene bridged thymidine
  MOD_RES (13)..(13): May be a 2 prime O, 4 prime C methylene bridged guanosine
  MOD_RES (14)..(14): May be a 2 prime O, 4 prime C methylene bridged cytidine
agcactctcagtgc

SEQ ID NO: 235 - DNA, 14 bp, Homo sapiens
cagcactctcagtg

SEQ ID NO: 236 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (2)..(2): May be a 2 prime O, 4 prime C methylene bridged adenosine
  MOD_RES (3)..(3): May be a 2 prime O, 4 prime C methylene bridged guanosine
  MOD_RES (4)..(4): May be a 2 prime O methyl deoxycytidine
  MOD_RES (6)..(6): May be a 2 prime O methyl deoxycytidine
  MOD_RES (8)..(8): May be a 2 prime O methyl deoxycytidine
  MOD_RES (10)..(10): May be a 2 prime O methyl deoxycytidine
  MOD_RES (12)..(12): May be a 2 prime O, 4 prime C methylene bridged guanosine
  MOD_RES (13)..(13): May be a 2 prime O, 4 prime C methylene bridged thymidine
  MOD_RES (14)..(14): May be a 2 prime O, 4 prime C methylene bridged guanosine
cagcactctcagtg

SEQ ID NO: 237 - DNA, 14 bp, Homo sapiens
tcagcactctcagt

SEQ ID NO: 238 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged cytidine
  MOD_RES (3)..(3): May be a 2 prime O, 4 prime C methylene bridged adenosine
  MOD_RES (5)..(5): May be a 2 prime O methyl deoxycytidine
  MOD_RES (7)..(7): May be a 2 prime O methyl deoxycytidine
  MOD_RES (9)..(9): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged adenosine
  MOD_RES (13)..(13): May be a 2 prime O, 4 prime C methylene bridged guanosine
  MOD_RES (14)..(14): May be a 2 prime O, 4 prime C methylene bridged thymidine
tcagcactctcagt

SEQ ID NO: 239 - DNA, 14 bp, Homo sapiens
gtcagcactctcag

SEQ ID NO: 240 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged thymidine
  MOD_RES (3)..(3): May be a 2 prime O, 4 prime C methylene bridged cytidine
  MOD_RES (6)..(6): May be a 2 prime O methyl deoxycytidine
  MOD_RES (8)..(8): May be a 2 prime O methyl deoxycytidine
  MOD_RES (10)..(10): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged adenosine
  MOD_RES (14)..(14): May be a 2 prime O, 4 prime C methylene bridged guanosine
gtcagcactctcag

SEQ ID NO: 241 - DNA, 14 bp, Homo sapiens
tgtcagcactctca

SEQ ID NO: 242 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged guanosine
  MOD_RES (3)..(3): May be a 2 prime O, 4 prime C methylene bridged thymidine
  MOD_RES (4)..(4): May be a 2 prime O methyl deoxycytidine
  MOD_RES (7)..(7): May be a 2 prime O methyl deoxycytidine
  MOD_RES (9)..(9): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged thymidine
  MOD_RES (13)..(13): May be a 2 prime O, 4 prime C methylene bridged cytidine
  MOD_RES (14)..(14): May be a 2 prime O, 4 prime C methylene bridged adenosine
tgtcagcactctca

SEQ ID NO: 243 - DNA, 14 bp, Homo sapiens
ccttgtcagcactc

SEQ ID NO: 244 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (2)..(2): May be a 2 prime O, 4 prime C methylene bridged cytidine
  MOD_RES (3)..(3): May be a 2 prime O, 4 prime C methylene bridged thymidine
  MOD_RES (7)..(7): May be a 2 prime O methyl deoxycytidine
  MOD_RES (10)..(10): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged thymidine
  MOD_RES (14)..(14): May be a 2 prime O, 4 prime C methylene bridged cytidine
ccttgtcagcactc

SEQ ID NO: 245 - DNA, 14 bp, Homo sapiens
cactgctgaccccc

SEQ ID NO: 246 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (2)..(2): May be a 2 prime O, 4 prime C methylene bridged adenosine
  MOD_RES (3)..(3): May be a 2 prime O, 4 prime C methylene bridged cytidine
  MOD_RES (6)..(6): May be a 2 prime O methyl deoxycytidine
  MOD_RES (10)..(10): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged cytidine
  MOD_RES (14)..(14): May be a 2 prime O, 4 prime C methylene bridged cytidine
cactgctgaccccc

SEQ ID NO: 247 - DNA, 14 bp, Homo sapiens
ccactgctgacccc

SEQ ID NO: 248 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (2)..(2): May be a 2 prime O, 4 prime C methylene bridged cytidine
  MOD_RES (3)..(3): May be a 2 prime O, 4 prime C methylene bridged adenosine
  MOD_RES (4)..(4): May be a 2 prime O methyl deoxycytidine
  MOD_RES (7)..(7): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged cytidine
  MOD_RES (14)..(14): May be a 2 prime O, 4 prime C methylene bridged cytidine
ccactgctgacccc

SEQ ID NO: 249 - DNA, 14 bp, Homo sapiens
cccactgctgaccc

SEQ ID NO: 250 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (2)..(2): May be a 2 prime O, 4 prime C methylene bridged cytidine
  MOD_RES (3)..(3): May be a 2 prime O, 4 prime C methylene bridged cytidine
  MOD_RES (5)..(5): May be a 2 prime O methyl deoxycytidine
  MOD_RES (8)..(8): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged cytidine
  MOD_RES (14)..(14): May be a 2 prime O, 4 prime C methylene bridged cytidine
cccactgctgaccc

SEQ ID NO: 251 - DNA, 14 bp, Homo sapiens
ccccactgctgacc

SEQ ID NO: 252 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (2)..(2): May be a 2 prime O, 4 prime C methylene bridged cytidine
  MOD_RES (3)..(3): May be a 2 prime O, 4 prime C methylene bridged cytidine
  MOD_RES (4)..(4): May be a 2 prime O methyl deoxycytidine
  MOD_RES (6)..(6): May be a 2 prime O methyl deoxycytidine
  MOD_RES (9)..(9): May be a 2 prime O methyl deoxycytidine
  MOD_RES (12)..(12): May be a 2 prime O, 4 prime C methylene bridged adenosine
  MOD_RES (13)..(13): May be a 2 prime O, 4 prime C methylene bridged cytidine
  MOD_RES (14)..(14): May be a 2 prime O, 4 prime C methylene bridged cytidine
ccccactgctgacc

SEQ ID NO: 253 - DNA, 14 bp, Homo sapiens
tccccactgctgac

SEQ ID NO: 254 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged cytidine
  MOD_RES (3)..(3): May be a 2 prime O, 4 prime C methylene bridged cytidine
  MOD_RES (4)..(4): May be a 2 prime O methyl deoxycytidine
  MOD_RES (5)..(5): May be a 2 prime O methyl deoxycytidine
  MOD_RES (7)..(7): May be a 2 prime O methyl deoxycytidine
  MOD_RES (10)..(10): May be a 2 prime O methyl deoxycytidine
  MOD_RES (12)..(12): May be a 2 prime O, 4 prime C methylene bridged guanosine
  MOD_RES (13)..(13): May be a 2 prime O, 4 prime C methylene bridged adenosine
  MOD_RES (14)..(14): May be a 2 prime O, 4 prime C methylene bridged cytidine
tccccactgctgac

SEQ ID NO: 255 - DNA, 14 bp, Homo sapiens
gtccccactgctga

SEQ ID NO: 256 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged thymidine
  MOD_RES (3)..(3): May be a 2 prime O, 4 prime C methylene bridged cytidine
  MOD_RES (4)..(4): May be a 2 prime O methyl deoxycytidine
  MOD_RES (5)..(5): May be a 2 prime O methyl deoxycytidine
  MOD_RES (6)..(6): May be a 2 prime O methyl deoxycytidine
  MOD_RES (8)..(8): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged thymidine
  MOD_RES (13)..(13): May be a 2 prime O, 4 prime C methylene bridged guanosine
  MOD_RES (14)..(14): May be a 2 prime O, 4 prime C methylene bridged adenosine
gtccccactgctga

SEQ ID NO: 257 - DNA, 14 bp, Homo sapiens
ggtccccactgctg

SEQ ID NO: 258 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged guanosine
  MOD_RES (3)..(3): May be a 2 prime O, 4 prime C methylene bridged thymidine
  MOD_RES (4)..(4): May be a 2 prime O methyl deoxycytidine
  MOD_RES (5)..(5): May be a 2 prime O methyl deoxycytidine
  MOD_RES (6)..(6): May be a 2 prime O methyl deoxycytidine
  MOD_RES (7)..(7): May be a 2 prime O methyl deoxycytidine
  MOD_RES (9)..(9): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged thymidine
  MOD_RES (14)..(14): May be a 2 prime O, 4 prime C methylene bridged guanosine
ggtccccactgctg

SEQ ID NO: 259 - DNA, 14 bp, Homo sapiens
aggtccccactgct

SEQ ID NO: 260 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged guanosine
  MOD_RES (3)..(3): May be a 2 prime O, 4 prime C methylene bridged guanosine
  MOD_RES (5)..(5): May be a 2 prime O methyl deoxycytidine
  MOD_RES (6)..(6): May be a 2 prime O methyl deoxycytidine
  MOD_RES (7)..(7): May be a 2 prime O methyl deoxycytidine
  MOD_RES (8)..(8): May be a 2 prime O methyl deoxycytidine
  MOD_RES (10)..(10): May be a 2 prime O methyl deoxycytidine
  MOD_RES (12)..(12): May be a 2 prime O, 4 prime C methylene bridged guanosine
  MOD_RES (13)..(13): May be a 2 prime O, 4 prime C methylene bridged cytidine
  MOD_RES (14)..(14): May be a 2 prime O, 4 prime C methylene bridged thymidine
aggtccccactgct

SEQ ID NO: 261 - DNA, 14 bp, Homo sapiens
gaggtccccactgc

SEQ ID NO: 262 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged adenosine
  MOD_RES (3)..(3): May be a 2 prime O, 4 prime C methylene bridged guanosine
  MOD_RES (6)..(6): May be a 2 prime O methyl deoxycytidine
  MOD_RES (7)..(7): May be a 2 prime O methyl deoxycytidine
  MOD_RES (8)..(8): May be a 2 prime O methyl deoxycytidine
  MOD_RES (9)..(9): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged thymidine
  MOD_RES (13)..(13): May be a 2 prime O, 4 prime C methylene bridged guanosine
  MOD_RES (14)..(14): May be a 2 prime O, 4 prime C methylene bridged cytidine
gaggtccccactgc

SEQ ID NO: 263 - DNA, 14 bp, Homo sapiens
ggaggtccccactg

SEQ ID NO: 264 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged guanosine
  MOD_RES (3)..(3): May be a 2 prime O, 4 prime C methylene bridged adenosine
  MOD_RES (7)..(7): May be a 2 prime O methyl deoxycytidine
  MOD_RES (8)..(8): May be a 2 prime O methyl deoxycytidine
  MOD_RES (9)..(9): May be a 2 prime O methyl deoxycytidine
  MOD_RES (10)..(10): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged thymidine
  MOD_RES (14)..(14): May be a 2 prime O, 4 prime C methylene bridged guanosine
ggaggtccccactg

SEQ ID NO: 265 - DNA, 14 bp, Homo sapiens
aggaggtccccact

SEQ ID NO: 266 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged guanosine
  MOD_RES (3)..(3): May be a 2 prime O, 4 prime C methylene bridged guanosine
  MOD_RES (8)..(8): May be a 2 prime O methyl deoxycytidine
  MOD_RES (9)..(9): May be a 2 prime O methyl deoxycytidine
  MOD_RES (10)..(10): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged adenosine
  MOD_RES (13)..(13): May be a 2 prime O, 4 prime C methylene bridged cytidine
  MOD_RES (14)..(14): May be a 2 prime O, 4 prime C methylene bridged thymidine
aggaggtccccact

SEQ ID NO: 267 - DNA, 14 bp, Homo sapiens
gaggaggtccccac

SEQ ID NO: 268 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged adenosine
  MOD_RES (3)..(3): May be a 2 prime O, 4 prime C methylene bridged guanosine
  MOD_RES (9)..(9): May be a 2 prime O methyl deoxycytidine
  MOD_RES (10)..(10): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged adenosine
  MOD_RES (14)..(14): May be a 2 prime O, 4 prime C methylene bridged cytidine
gaggaggtccccac

SEQ ID NO: 269 - DNA, 14 bp, Homo sapiens
tgaggaggtcccca

SEQ ID NO: 270 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged guanosine
  MOD_RES (3)..(3): May be a 2 prime O, 4 prime C methylene bridged adenosine
  MOD_RES (10)..(10): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged cytidine
  MOD_RES (14)..(14): May be a 2 prime O, 4 prime C methylene bridged adenosine
tgaggaggtcccca

SEQ ID NO: 271 - DNA, 14 bp, Homo sapiens
tttgaggaggtccc

SEQ ID NO: 272 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged thymidine
  MOD_RES (3)..(3): May be a 2 prime O, 4 prime C methylene bridged thymidine
  MOD_RES (12)..(12): May be a 2 prime O, 4 prime C methylene bridged cytidine
  MOD_RES (13)..(13): May be a 2 prime O, 4 prime C methylene bridged cytidine
  MOD_RES (14)..(14): May be a 2 prime O, 4 prime C methylene bridged cytidine
tttgaggaggtccc

SEQ ID NO: 273 - DNA, 14 bp, Homo sapiens
aaggcctttgagga

SEQ ID NO: 274 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged adenosine
  MOD_RES (3)..(3): May be a 2 prime O, 4 prime C methylene bridged guanosine
  MOD_RES (5)..(5): May be a 2 prime O methyl deoxycytidine
  MOD_RES (6)..(6): May be a 2 prime O methyl deoxycytidine
  MOD_RES (12)..(12): May be a 2 prime O, 4 prime C methylene bridged guanosine
  MOD_RES (13)..(13): May be a 2 prime O, 4 prime C methylene bridged guanosine
  MOD_RES (14)..(14): May be a 2 prime O, 4 prime C methylene bridged adenosine
aaggcctttgagga

SEQ ID NO: 275 - DNA, 14 bp, Homo sapiens
gcaaacaccacctg

SEQ ID NO: 276 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged cytidine
  MOD_RES (3)..(3): May be a 2 prime O, 4 prime C methylene bridged adenosine
  MOD_RES (6)..(6): May be a 2 prime O methyl deoxycytidine
  MOD_RES (8)..(8): May be a 2 prime O methyl deoxycytidine
  MOD_RES (9)..(9): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged thymidine
  MOD_RES (14)..(14): May be a 2 prime O, 4 prime C methylene bridged guanosine
gcaaacaccacctg

SEQ ID NO: 277 - DNA, 14 bp, Homo sapiens
agcaaacaccacct

SEQ ID NO: 278 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged guanosine
  MOD_RES (3)..(3): May be a 2 prime O, 4 prime C methylene bridged cytidine
  MOD_RES (7)..(7): May be a 2 prime O methyl deoxycytidine
  MOD_RES (9)..(9): May be a 2 prime O methyl deoxycytidine
  MOD_RES (10)..(10): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged cytidine
  MOD_RES (14)..(14): May be a 2 prime O, 4 prime C methylene bridged thymidine
agcaaacaccacct

SEQ ID NO: 279 - DNA, 14 bp, Homo sapiens
cagcaaacaccacc

SEQ ID NO: 280 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (2)..(2): May be a 2 prime O, 4 prime C methylene bridged adenosine
  MOD_RES (3)..(3): May be a 2 prime O, 4 prime C methylene bridged guanosine
  MOD_RES (4)..(4): May be a 2 prime O methyl deoxycytidine
  MOD_RES (8)..(8): May be a 2 prime O methyl deoxycytidine
  MOD_RES (10)..(10): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged adenosine
  MOD_RES (13)..(13): May be a 2 prime O, 4 prime C methylene bridged cytidine
  MOD_RES (14)..(14): May be a 2 prime O, 4 prime C methylene bridged cytidine
cagcaaacaccacc

SEQ ID NO: 281 - DNA, 14 bp, Homo sapiens
acagcaaacaccac

SEQ ID NO: 282 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged cytidine
  MOD_RES (3)..(3): May be a 2 prime O, 4 prime C methylene bridged adenosine
  MOD_RES (5)..(5): May be a 2 prime O methyl deoxycytidine
  MOD_RES (9)..(9): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged adenosine
  MOD_RES (14)..(14): May be a 2 prime O, 4 prime C methylene bridged cytidine
acagcaaacaccac

SEQ ID NO: 283 - DNA, 14 bp, Homo sapiens
agacaccagccacc

SEQ ID NO: 284 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged guanosine
  MOD_RES (3)..(3): May be a 2 prime O, 4 prime C methylene bridged adenosine
  MOD_RES (4)..(4): May be a 2 prime O methyl deoxycytidine
  MOD_RES (6)..(6): May be a 2 prime O methyl deoxycytidine
  MOD_RES (7)..(7): May be a 2 prime O methyl deoxycytidine
  MOD_RES (10)..(10): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged adenosine
  MOD_RES (13)..(13): May be a 2 prime O, 4 prime C methylene bridged cytidine
  MOD_RES (14)..(14): May be a 2 prime O, 4 prime C methylene bridged cytidine
agacaccagccacc

SEQ ID NO: 285 - DNA, 14 bp, Homo sapiens
gagacaccagccac

SEQ ID NO: 286 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged adenosine
  MOD_RES (3)..(3): May be a 2 prime O, 4 prime C methylene bridged guanosine
  MOD_RES (5)..(5): May be a 2 prime O methyl deoxycytidine
  MOD_RES (7)..(7): May be a 2 prime O methyl deoxycytidine
  MOD_RES (8)..(8): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged adenosine
  MOD_RES (14)..(14): May be a 2 prime O, 4 prime C methylene bridged cytidine
gagacaccagccac

SEQ ID NO: 287 - DNA, 14 bp, Homo sapiens
cttcttgtcaggcc

SEQ ID NO: 288 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (2)..(2): May be a 2 prime O, 4 prime C methylene bridged thymidine
  MOD_RES (3)..(3): May be a 2 prime O, 4 prime C methylene bridged thymidine
  MOD_RES (4)..(4): May be a 2 prime O methyl deoxycytidine
  MOD_RES (9)..(9): May be a 2 prime O methyl deoxycytidine
  MOD_RES (12)..(12): May be a 2 prime O, 4 prime C methylene bridged guanosine
  MOD_RES (13)..(13): May be a 2 prime O, 4 prime C methylene bridged cytidine
  MOD_RES (14)..(14): May be a 2 prime O, 4 prime C methylene bridged cytidine
cttcttgtcaggcc

SEQ ID NO: 289 - DNA, 14 bp, Homo sapiens
aagtgggcctggta

SEQ ID NO: 290 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged adenosine
  MOD_RES (3)..(3): May be a 2 prime O, 4 prime C methylene bridged guanosine
  MOD_RES (8)..(8): May be a 2 prime O methyl deoxycytidine
  MOD_RES (9)..(9): May be a 2 prime O methyl deoxycytidine
  MOD_RES (12)..(12): May be a 2 prime O, 4 prime C methylene bridged guanosine
  MOD_RES (13)..(13): May be a 2 prime O, 4 prime C methylene bridged thymidine
  MOD_RES (14)..(14): May be a 2 prime O, 4 prime C methylene bridged adenosine
aagtgggcctggta

SEQ ID NO: 291 - DNA, 14 bp, Homo sapiens
gtagtggaccacct

SEQ ID NO: 292 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged thymidine
  MOD_RES (3)..(3): May be a 2 prime O, 4 prime C methylene bridged adenosine
  MOD_RES (9)..(9): May be a 2 prime O methyl deoxycytidine
  MOD_RES (10)..(10): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged cytidine
  MOD_RES (14)..(14): May be a 2 prime O, 4 prime C methylene bridged thymidine
gtagtggaccacct

SEQ ID NO: 293 - DNA, 14 bp, Homo sapiens
gcatccatgacccc

SEQ ID NO: 294 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged cytidine
  MOD_RES (3)..(3): May be a 2 prime O, 4 prime C methylene bridged adenosine
  MOD_RES (5)..(5): May be a 2 prime O methyl deoxycytidine
  MOD_RES (6)..(6): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged cytidine
  MOD_RES (14)..(14): May be a 2 prime O, 4 prime C methylene bridged cytidine
gcatccatgacccc

SEQ ID NO: 295 - DNA, 14 bp, Homo sapiens
ggcatccatgaccc

SEQ ID NO: 296 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged guanosine
  MOD_RES (3)..(3): May be a 2 prime O, 4 prime C methylene bridged cytidine
  MOD_RES (6)..(6): May be a 2 prime O methyl deoxycytidine
  MOD_RES (7)..(7): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged cytidine
  MOD_RES (14)..(14): May be a 2 prime O, 4 prime C methylene bridged cytidine
ggcatccatgaccc

SEQ ID NO: 297 - DNA, 14 bp, Homo sapiens
aggcatccatgacc

SEQ ID NO: 298 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged guanosine
  MOD_RES (3)..(3): May be a 2 prime O, 4 prime C methylene bridged guanosine
  MOD_RES (4)..(4): May be a 2 prime O methyl deoxycytidine
  MOD_RES (7)..(7): May be a 2 prime O methyl deoxycytidine
  MOD_RES (8)..(8): May be a 2 prime O methyl deoxycytidine
  MOD_RES (12)..(12): May be a 2 prime O, 4 prime C methylene bridged adenosine
  MOD_RES (13)..(13): May be a 2 prime O, 4 prime C methylene bridged cytidine
  MOD_RES (14)..(14): May be a 2 prime O, 4 prime C methylene bridged cytidine
aggcatccatgacc

SEQ ID NO: 299 - DNA, 14 bp, Homo sapiens
aaggcatccatgac

SEQ ID NO: 300 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged adenosine
  MOD_RES (3)..(3): May be a 2 prime O, 4 prime C methylene bridged guanosine
  MOD_RES (5)..(5): May be a 2 prime O methyl deoxycytidine
  MOD_RES (8)..(8): May be a 2 prime O methyl deoxycytidine
  MOD_RES (9)..(9): May be a 2 prime O methyl deoxycytidine
  MOD_RES (12)..(12): May be a 2 prime O, 4 prime C methylene bridged guanosine
  MOD_RES (13)..(13): May be a 2 prime O, 4 prime C methylene bridged adenosine
  MOD_RES (14)..(14): May be a 2 prime O, 4 prime C methylene bridged cytidine
aaggcatccatgac

SEQ ID NO: 301 - DNA, 14 bp, Homo sapiens
tgatcctcataggt

SEQ ID NO: 302 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged guanosine
  MOD_RES (3)..(3): May be a 2 prime O, 4 prime C methylene bridged adenosine
  MOD_RES (5)..(5): May be a 2 prime O methyl deoxycytidine
  MOD_RES (6)..(6): May be a 2 prime O methyl deoxycytidine
  MOD_RES (8)..(8): May be a 2 prime O methyl deoxycytidine
  MOD_RES (12)..(12): May be a 2 prime O, 4 prime C methylene bridged guanosine
  MOD_RES (13)..(13): May be a 2 prime O, 4 prime C methylene bridged guanosine
  MOD_RES (14)..(14): May be a 2 prime O, 4 prime C methylene bridged thymidine
tgatcctcataggt

SEQ ID NO: 303 - DNA, 14 bp, Homo sapiens
ctgatcctcatagg

SEQ ID NO: 304 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (2)..(2): May be a 2 prime O, 4 prime C methylene bridged thymidine
  MOD_RES (3)..(3): May be a 2 prime O, 4 prime C methylene bridged guanosine
  MOD_RES (6)..(6): May be a 2 prime O methyl deoxycytidine
  MOD_RES (7)..(7): May be a 2 prime O methyl deoxycytidine
  MOD_RES (9)..(9): May be a 2 prime O methyl deoxycytidine
  MOD_RES (12)..(12): May be a 2 prime O, 4 prime C methylene bridged adenosine
  MOD_RES (13)..(13): May be a 2 prime O, 4 prime C methylene bridged guanosine
  MOD_RES (14)..(14): May be a 2 prime O, 4 prime C methylene bridged guanosine
ctgatcctcatagg

SEQ ID NO: 305 - DNA, 14 bp, Homo sapiens
gctgatcctcatag

SEQ ID NO: 306 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged cytidine
  MOD_RES (3)..(3): May be a 2 prime O, 4 prime C methylene bridged thymidine
  MOD_RES (7)..(7): May be a 2 prime O methyl deoxycytidine
  MOD_RES (8)..(8): May be a 2 prime O methyl deoxycytidine
  MOD_RES (10)..(10): May be a 2 prime O methyl deoxycytidine
  MOD_RES (12)..(12): May be a 2 prime O, 4 prime C methylene bridged thymidine
  MOD_RES (13)..(13): May be a 2 prime O, 4 prime C methylene bridged adenosine
  MOD_RES (14)..(14): May be a 2 prime O, 4 prime C methylene bridged guanosine
gctgatcctcatag

SEQ ID NO: 307 - DNA, 14 bp, Homo sapiens
agctgatcctcata

SEQ ID NO: 308 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged guanosine
  MOD_RES (3)..(3): May be a 2 prime O, 4 prime C methylene bridged cytidine
  MOD_RES (8)..(8): May be a 2 prime O methyl deoxycytidine
  MOD_RES (9)..(9): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged adenosine
  MOD_RES (13)..(13): May be a 2 prime O, 4 prime C methylene bridged thymidine
  MOD_RES (14)..(14): May be a 2 prime O, 4 prime C methylene bridged adenosine
agctgatcctcata

SEQ ID NO: 309 - DNA, 14 bp, Homo sapiens
accttgatcttggc

SEQ ID NO: 310 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged cytidine
  MOD_RES (3)..(3): May be a 2 prime O, 4 prime C methylene bridged cytidine
  MOD_RES (9)..(9): May be a 2 prime O methyl deoxycytidine
  MOD_RES (12)..(12): May be a 2 prime O, 4 prime C methylene bridged guanosine
  MOD_RES (13)..(13): May be a 2 prime O, 4 prime C methylene bridged guanosine
  MOD_RES (14)..(14): May be a 2 prime O, 4 prime C methylene bridged cytidine
accttgatcttggc

SEQ ID NO: 311 - DNA, 14 bp, Homo sapiens
atggcatctgcttc

SEQ ID NO: 312 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged thymidine
  MOD_RES (3)..(3): May be a 2 prime O, 4 prime C methylene bridged guanosine
  MOD_RES (5)..(5): May be a 2 prime O methyl deoxycytidine
  MOD_RES (8)..(8): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged thymidine
  MOD_RES (13)..(13): May be a 2 prime O, 4 prime C methylene bridged thymidine
  MOD_RES (14)..(14): May be a 2 prime O, 4 prime C methylene bridged cytidine
atggcatctgcttc

SEQ ID NO: 313 - DNA, 14 bp, Homo sapiens
gatggcatctgctt

SEQ ID NO: 314 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged adenosine
  MOD_RES (3)..(3): May be a 2 prime O, 4 prime C methylene bridged thymidine
  MOD_RES (6)..(6): May be a 2 prime O methyl deoxycytidine
  MOD_RES (9)..(9): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged thymidine
  MOD_RES (14)..(14): May be a 2 prime O, 4 prime C methylene bridged thymidine
gatggcatctgctt

SEQ ID NO: 315 - DNA, 14 bp, Homo sapiens
tctggatggcatct

SEQ ID NO: 316 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged cytidine
  MOD_RES (3)..(3): May be a 2 prime O, 4 prime C methylene bridged thymidine
  MOD_RES (10)..(10): May be a 2 prime O methyl deoxycytidine
  MOD_RES (12)..(12): May be a 2 prime O, 4 prime C methylene bridged thymidine
  MOD_RES (13)..(13): May be a 2 prime O, 4 prime C methylene bridged cytidine
  MOD_RES (14)..(14): May be a 2 prime O, 4 prime C methylene bridged thymidine
tctggatggcatct

SEQ ID NO: 317 - DNA, 14 bp, Homo sapiens
accttgctctgcag

SEQ ID NO: 318 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged cytidine
  MOD_RES (3)..(3): May be a 2 prime O, 4 prime C methylene bridged cytidine
  MOD_RES (7)..(7): May be a 2 prime O methyl deoxycytidine
  MOD_RES (9)..(9): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged adenosine
  MOD_RES (14)..(14): May be a 2 prime O, 4 prime C methylene bridged guanosine
accttgctctgcag

SEQ ID NO: 319 - DNA, 14 bp, Homo sapiens
aggcagcaggcact

SEQ ID NO: 320 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged guanosine
  MOD_RES (3)..(3): May be a 2 prime O, 4 prime C methylene bridged guanosine
  MOD_RES (4)..(4): May be a 2 prime O methyl deoxycytidine
  MOD_RES (7)..(7): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged adenosine
  MOD_RES (13)..(13): May be a 2 prime O, 4 prime C methylene bridged cytidine
  MOD_RES (14)..(14): May be a 2 prime O, 4 prime C methylene bridged thymidine
aggcagcaggcact

SEQ ID NO: 321 - DNA, 14 bp, Homo sapiens
aaggcagcaggcac

SEQ ID NO: 322 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged adenosine
  MOD_RES (3)..(3): May be a 2 prime O, 4 prime C methylene bridged guanosine
  MOD_RES (5)..(5): May be a 2 prime O methyl deoxycytidine
  MOD_RES (8)..(8): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged adenosine
  MOD_RES (14)..(14): May be a 2 prime O, 4 prime C methylene bridged cytidine
aaggcagcaggcac

SEQ ID NO: 323 - DNA, 14 bp, Homo sapiens
caaggcagcaggca

SEQ ID NO: 324 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (2)..(2): May be a 2 prime O, 4 prime C methylene bridged adenosine
  MOD_RES (3)..(3): May be a 2 prime O, 4 prime C methylene bridged adenosine
  MOD_RES (6)..(6): May be a 2 prime O methyl deoxycytidine
  MOD_RES (9)..(9): May be a 2 prime O methyl deoxycytidine
  MOD_RES (12)..(12): May be a 2 prime O, 4 prime C methylene bridged guanosine
  MOD_RES (13)..(13): May be a 2 prime O, 4 prime C methylene bridged cytidine
  MOD_RES (14)..(14): May be a 2 prime O, 4 prime C methylene bridged adenosine
caaggcagcaggca

SEQ ID NO: 325 - DNA, 14 bp, Homo sapiens
ccaaggcagcaggc

SEQ ID NO: 326 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (2)..(2): May be a 2 prime O, 4 prime C methylene bridged cytidine
  MOD_RES (3)..(3): May be a 2 prime O, 4 prime C methylene bridged adenosine
  MOD_RES (7)..(7): May be a 2 prime O methyl deoxycytidine
  MOD_RES (10)..(10): May be a 2 prime O methyl deoxycytidine
  MOD_RES (12)..(12): May be a 2 prime O, 4 prime C methylene bridged guanosine
  MOD_RES (13)..(13): May be a 2 prime O, 4 prime C methylene bridged guanosine
  MOD_RES (14)..(14): May be a 2 prime O, 4 prime C methylene bridged cytidine
ccaaggcagcaggc

SEQ ID NO: 327 - DNA, 14 bp, Homo sapiens
ggtgaaggaggagg

SEQ ID NO: 328 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged guanosine
  MOD_RES (3)..(3): May be a 2 prime O, 4 prime C methylene bridged thymidine
  MOD_RES (12)..(12): May be a 2 prime O, 4 prime C methylene bridged adenosine
  MOD_RES (13)..(13): May be a 2 prime O, 4 prime C methylene bridged guanosine
  MOD_RES (14)..(14): May be a 2 prime O, 4 prime C methylene bridged guanosine
ggtgaaggaggagg

SEQ ID NO: 329 - DNA, 14 bp, Homo sapiens
gggtgaaggaggag

SEQ ID NO: 330 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged guanosine
  MOD_RES (3)..(3): May be a 2 prime O, 4 prime C methylene bridged guanosine
  MOD_RES (12)..(12): May be a 2 prime O, 4 prime C methylene bridged guanosine
  MOD_RES (13)..(13): May be a 2 prime O, 4 prime C methylene bridged adenosine
  MOD_RES (14)..(14): May be a 2 prime O, 4 prime C methylene bridged guanosine
gggtgaaggaggag

SEQ ID NO: 331 - DNA, 14 bp, Homo sapiens
tcacatccatcatg

SEQ ID NO: 332 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged cytidine
  MOD_RES (3)..(3): May be a 2 prime O, 4 prime C methylene bridged adenosine
  MOD_RES (4)..(4): May be a 2 prime O methyl deoxycytidine
  MOD_RES (7)..(7): May be a 2 prime O methyl deoxycytidine
  MOD_RES (8)..(8): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged adenosine
  MOD_RES (13)..(13): May be a 2 prime O, 4 prime C methylene bridged thymidine
  MOD_RES (14)..(14): May be a 2 prime O, 4 prime C methylene bridged guanosine
tcacatccatcatg

SEQ ID NO: 333 - DNA, 14 bp, Homo sapiens
actcacatccatca

SEQ ID NO: 334 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged cytidine
  MOD_RES (3)..(3): May be a 2 prime O, 4 prime C methylene bridged thymidine
  MOD_RES (4)..(4): May be a 2 prime O methyl deoxycytidine
  MOD_RES (6)..(6): May be a 2 prime O methyl deoxycytidine
  MOD_RES (9)..(9): May be a 2 prime O methyl deoxycytidine
  MOD_RES (10)..(10): May be a 2 prime O methyl deoxycytidine
  MOD_RES (12)..(12): May be a 2 prime O, 4 prime C methylene bridged thymidine
  MOD_RES (13)..(13): May be a 2 prime O, 4 prime C methylene bridged cytidine
  MOD_RES (14)..(14): May be a 2 prime O, 4 prime C methylene bridged adenosine
actcacatccatca

SEQ ID NO: 335 - DNA, 14 bp, Homo sapiens
cactcacatccatc

SEQ ID NO: 336 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (2)..(2): May be a 2 prime O, 4 prime C methylene bridged adenosine
  MOD_RES (3)..(3): May be a 2 prime O, 4 prime C methylene bridged cytidine
  MOD_RES (5)..(5): May be a 2 prime O methyl deoxycytidine
  MOD_RES (7)..(7): May be a 2 prime O methyl deoxycytidine
  MOD_RES (10)..(10): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged adenosine
  MOD_RES (13)..(13): May be a 2 prime O, 4 prime C methylene bridged thymidine
  MOD_RES (14)..(14): May be a 2 prime O, 4 prime C methylene bridged cytidine
cactcacatccatc

SEQ ID NO: 337 - DNA, 14 bp, Homo sapiens
ttcatcaggcaccc

SEQ ID NO: 338 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged thymidine
  MOD_RES (3)..(3): May be a 2 prime O, 4 prime C methylene bridged cytidine
  MOD_RES (6)..(6): May be a 2 prime O methyl deoxycytidine
  MOD_RES (10)..(10): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged cytidine
  MOD_RES (14)..(14): May be a 2 prime O, 4 prime C methylene bridged cytidine
ttcatcaggcaccc

SEQ ID NO: 339 - DNA, 14 bp, Homo sapiens
gttcatcaggcacc

SEQ ID NO: 340 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged thymidine
  MOD_RES (3)..(3): May be a 2 prime O, 4 prime C methylene bridged thymidine
  MOD_RES (4)..(4): May be a 2 prime O methyl deoxycytidine
  MOD_RES (7)..(7): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged adenosine
  MOD_RES (13)..(13): May be a 2 prime O, 4 prime C methylene bridged cytidine
  MOD_RES (14)..(14): May be a 2 prime O, 4 prime C methylene bridged cytidine
gttcatcaggcacc

SEQ ID NO: 341 - DNA, 14 bp, Homo sapiens
gtcctgttcatcag

SEQ ID NO: 342 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged thymidine
  MOD_RES (3)..(3): May be a 2 prime O, 4 prime C methylene bridged cytidine
  MOD_RES (4)..(4): May be a 2 prime O methyl deoxycytidine
  MOD_RES (9)..(9): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged adenosine
  MOD_RES (14)..(14): May be a 2 prime O, 4 prime C methylene bridged guanosine
gtcctgttcatcag

SEQ ID NO: 343 - DNA, 14 bp, Homo sapiens
tggtctttggtctc

SEQ ID NO: 344 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged guanosine
  MOD_RES (3)..(3): May be a 2 prime O, 4 prime C methylene bridged guanosine
  MOD_RES (5)..(5): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged thymidine
  MOD_RES (14)..(14): May be a 2 prime O, 4 prime C methylene bridged cytidine
tggtctttggtctc

SEQ ID NO: 345 - DNA, 14 bp, Homo sapiens
ttgtgcagcacaga

SEQ ID NO: 346 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged thymidine
  MOD_RES (3)..(3): May be a 2 prime O, 4 prime C methylene bridged guanosine
  MOD_RES (6)..(6): May be a 2 prime O methyl deoxycytidine
  MOD_RES (9)..(9): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged adenosine
  MOD_RES (13)..(13): May be a 2 prime O, 4 prime C methylene bridged guanosine
  MOD_RES (14)..(14): May be a 2 prime O, 4 prime C methylene bridged adenosine
ttgtgcagcacaga

SEQ ID NO: 347 - DNA, 14 bp, Homo sapiens
gttgtgcagcacag

SEQ ID NO: 348 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged thymidine
  MOD_RES (3)..(3): May be a 2 prime O, 4 prime C methylene bridged thymidine
  MOD_RES (7)..(7): May be a 2 prime O methyl deoxycytidine
  MOD_RES (10)..(10): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged adenosine
  MOD_RES (14)..(14): May be a 2 prime O, 4 prime C methylene bridged guanosine
gttgtgcagcacag

SEQ ID NO: 349 - DNA, 14 bp, Homo sapiens
gactgggagccatt

SEQ ID NO: 350 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged adenosine
  MOD_RES (3)..(3): May be a 2 prime O, 4 prime C methylene bridged cytidine
  MOD_RES (10)..(10): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged adenosine
  MOD_RES (13)..(13): May be a 2 prime O, 4 prime C methylene bridged thymidine
  MOD_RES (14)..(14): May be a 2 prime O, 4 prime C methylene bridged thymidine
gactgggagccatt

SEQ ID NO: 351 - DNA, 14 bp, Homo sapiens
agactgggagccat

SEQ ID NO: 352 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged guanosine
  MOD_RES (3)..(3): May be a 2 prime O, 4 prime C methylene bridged adenosine
  MOD_RES (4)..(4): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged adenosine
  MOD_RES (14)..(14): May be a 2 prime O, 4 prime C methylene bridged thymidine
agactgggagccat

SEQ ID NO: 353 - DNA, 14 bp, Homo sapiens
gtctcccagggcag

SEQ ID NO: 354 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged thymidine
  MOD_RES (3)..(3): May be a 2 prime O, 4 prime C methylene bridged cytidine
  MOD_RES (5)..(5): May be a 2 prime O methyl deoxycytidine
  MOD_RES (6)..(6): May be a 2 prime O methyl deoxycytidine
  MOD_RES (7)..(7): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged adenosine
  MOD_RES (14)..(14): May be a 2 prime O, 4 prime C methylene bridged guanosine
gtctcccagggcag

SEQ ID NO: 355 - DNA, 14 bp, Homo sapiens
ctcagggtcttggc

SEQ ID NO: 356 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (2)..(2): May be a 2 prime O, 4 prime C methylene bridged thymidine
  MOD_RES (3)..(3): May be a 2 prime O, 4 prime C methylene bridged cytidine
  MOD_RES (9)..(9): May be a 2 prime O methyl deoxycytidine
  MOD_RES (12)..(12): May be a 2 prime O, 4 prime C methylene bridged guanosine
  MOD_RES (13)..(13): May be a 2 prime O, 4 prime C methylene bridged guanosine
  MOD_RES (14)..(14): May be a 2 prime O, 4 prime C methylene bridged cytidine
ctcagggtcttggc

SEQ ID NO: 357 - DNA, 14 bp, Homo sapiens
cctcagggtcttgg

SEQ ID NO: 358 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (2)..(2): May be a 2 prime O, 4 prime C methylene bridged cytidine
  MOD_RES (3)..(3): May be a 2 prime O, 4 prime C methylene bridged thymidine
  MOD_RES (4)..(4): May be a 2 prime O methyl deoxycytidine
  MOD_RES (10)..(10): May be a 2 prime O methyl deoxycytidine
  MOD_RES (12)..(12): May be a 2 prime O, 4 prime C methylene bridged thymidine
  MOD_RES (13)..(13): May be a 2 prime O, 4 prime C methylene bridged guanosine
  MOD_RES (14)..(14): May be a 2 prime O, 4 prime C methylene bridged guanosine
cctcagggtcttgg

SEQ ID NO: 359 - DNA, 14 bp, Homo sapiens
tcctcagggtcttg

SEQ ID NO: 360 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged cytidine
  MOD_RES (3)..(3): May be a 2 prime O, 4 prime C methylene bridged cytidine
  MOD_RES (5)..(5): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged thymidine
  MOD_RES (13)..(13): May be a 2 prime O, 4 prime C methylene bridged thymidine
  MOD_RES (14)..(14): May be a 2 prime O, 4 prime C methylene bridged guanosine
tcctcagggtcttg

SEQ ID NO: 361 - DNA, 14 bp, Homo sapiens
attcctcagggtct

SEQ ID NO: 362 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged thymidine
  MOD_RES (3)..(3): May be a 2 prime O, 4 prime C methylene bridged thymidine
  MOD_RES (4)..(4): May be a 2 prime O methyl deoxycytidine
  MOD_RES (5)..(5): May be a 2 prime O methyl deoxycytidine
  MOD_RES (7)..(7): May be a 2 prime O methyl deoxycytidine
  MOD_RES (12)..(12): May be a 2 prime O, 4 prime C methylene bridged thymidine
  MOD_RES (13)..(13): May be a 2 prime O, 4 prime C methylene bridged cytidine
  MOD_RES (14)..(14): May be a 2 prime O, 4 prime C methylene bridged thymidine
attcctcagggtct

SEQ ID NO: 363 - DNA, 14 bp, Homo sapiens
cattcctcagggtc

SEQ ID NO: 364 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (2)..(2): May be a 2 prime O, 4 prime C methylene bridged adenosine
  MOD_RES (3)..(3): May be a 2 prime O, 4 prime C methylene bridged thymidine
  MOD_RES (5)..(5): May be a 2 prime O methyl deoxycytidine
  MOD_RES (6)..(6): May be a 2 prime O methyl deoxycytidine
  MOD_RES (8)..(8): May be a 2 prime O methyl deoxycytidine
  MOD_RES (12)..(12): May be a 2 prime O, 4 prime C methylene bridged guanosine
  MOD_RES (13)..(13): May be a 2 prime O, 4 prime C methylene bridged thymidine
  MOD_RES (14)..(14): May be a 2 prime O, 4 prime C methylene bridged cytidine
cattcctcagggtc

SEQ ID NO: 365 - DNA, 14 bp, Homo sapiens
atcattcctcaggg

SEQ ID NO: 366 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged thymidine
  MOD_RES (3)..(3): May be a 2 prime O, 4 prime C methylene bridged cytidine
  MOD_RES (7)..(7): May be a 2 prime O methyl deoxycytidine
  MOD_RES (8)..(8): May be a 2 prime O methyl deoxycytidine
  MOD_RES (10)..(10): May be a 2 prime O methyl deoxycytidine
  MOD_RES (12)..(12): May be a 2 prime O, 4 prime C methylene bridged guanosine
  MOD_RES (13)..(13): May be a 2 prime O, 4 prime C methylene bridged guanosine
  MOD_RES (14)..(14): May be a 2 prime O, 4 prime C methylene bridged guanosine
atcattcctcaggg

SEQ ID NO: 367 - DNA, 14 bp, Homo sapiens
gttatcattcctca

SEQ ID NO: 368 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged thymidine
  MOD_RES (3)..(3): May be a 2 prime O, 4 prime C methylene bridged thymidine
  MOD_RES (6)..(6): May be a 2 prime O methyl deoxycytidine
  MOD_RES (10)..(10): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged thymidine
  MOD_RES (13)..(13): May be a 2 prime O, 4 prime C methylene bridged cytidine
  MOD_RES (14)..(14): May be a 2 prime O, 4 prime C methylene bridged adenosine
gttatcattcctca

SEQ ID NO: 369 - DNA, 14 bp, Homo sapiens
agttatcattcctc

SEQ ID NO: 370 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged guanosine
  MOD_RES (3)..(3): May be a 2 prime O, 4 prime C methylene bridged thymidine
  MOD_RES (7)..(7): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged thymidine
  MOD_RES (14)..(14): May be a 2 prime O, 4 prime C methylene bridged cytidine
agttatcattcctc

SEQ ID NO: 371 - DNA, 14 bp, Homo sapiens
agggaccaaagtga

SEQ ID NO: 372 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged guanosine
  MOD_RES (3)..(3): May be a 2 prime O, 4 prime C methylene bridged guanosine
  MOD_RES (6)..(6): May be a 2 prime O methyl deoxycytidine
  MOD_RES (7)..(7): May be a 2 prime O methyl deoxycytidine
  MOD_RES (12)..(12): May be a 2 prime O, 4 prime C methylene bridged thymidine
  MOD_RES (13)..(13): May be a 2 prime O, 4 prime C methylene bridged guanosine
  MOD_RES (14)..(14): May be a 2 prime O, 4 prime C methylene bridged adenosine
agggaccaaagtga

SEQ ID NO: 373 - DNA, 14 bp, Homo sapiens
cccagagggaccaa

SEQ ID NO: 374 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (2)..(2): May be a 2 prime O, 4 prime C methylene bridged cytidine
  MOD_RES (3)..(3): May be a 2 prime O, 4 prime C methylene bridged cytidine
  MOD_RES (11)..(11): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged adenosine
  MOD_RES (14)..(14): May be a 2 prime O, 4 prime C methylene bridged adenosine
cccagagggaccaa

SEQ ID NO: 375 - DNA, 14 bp, Homo sapiens
tcccagagggacca

SEQ ID NO: 376 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged cytidine
  MOD_RES (3)..(3): May be a 2 prime O, 4 prime C methylene bridged cytidine
  MOD_RES (4)..(4): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged cytidine
  MOD_RES (14)..(14): May be a 2 prime O, 4 prime C methylene bridged adenosine
tcccagagggacca

SEQ ID NO: 377 - DNA, 14 bp, Homo sapiens
ttcccagagggacc

SEQ ID NO: 378 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged thymidine
  MOD_RES (3)..(3): May be a 2 prime O, 4 prime C methylene bridged cytidine
  MOD_RES (4)..(4): May be a 2 prime O methyl deoxycytidine
  MOD_RES (5)..(5): May be a 2 prime O methyl deoxycytidine
  MOD_RES (12)..(12): May be a 2 prime O, 4 prime C methylene bridged adenosine
  MOD_RES (13)..(13): May be a 2 prime O, 4 prime C methylene bridged cytidine
  MOD_RES (14)..(14): May be a 2 prime O, 4 prime C methylene bridged cytidine
ttcccagagggacc

SEQ ID NO: 379 - DNA, 14 bp, Homo sapiens
cttcccagagggac

SEQ ID NO: 380 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (2)..(2): May be a 2 prime O, 4 prime C methylene bridged thymidine
  MOD_RES (3)..(3): May be a 2 prime O, 4 prime C methylene bridged thymidine
  MOD_RES (4)..(4): May be a 2 prime O methyl deoxycytidine
  MOD_RES (5)..(5): May be a 2 prime O methyl deoxycytidine
  MOD_RES (6)..(6): May be a 2 prime O methyl deoxycytidine
  MOD_RES (12)..(12): May be a 2 prime O, 4 prime C methylene bridged guanosine
  MOD_RES (13)..(13): May be a 2 prime O, 4 prime C methylene bridged adenosine
  MOD_RES (14)..(14): May be a 2 prime O, 4 prime C methylene bridged cytidine
cttcccagagggac

SEQ ID NO: 381 - DNA, 14 bp, Homo sapiens
gcttcccagaggga

SEQ ID NO: 382 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged cytidine
  MOD_RES (3)..(3): May be a 2 prime O, 4 prime C methylene bridged thymidine
  MOD_RES (5)..(5): May be a 2 prime O methyl deoxycytidine
  MOD_RES (6)..(6): May be a 2 prime O methyl deoxycytidine
  MOD_RES (7)..(7): May be a 2 prime O methyl deoxycytidine
  MOD_RES (12)..(12): May be a 2 prime O, 4 prime C methylene bridged guanosine
  MOD_RES (13)..(13): May be a 2 prime O, 4 prime C methylene bridged guanosine
  MOD_RES (14)..(14): May be a 2 prime O, 4 prime C methylene bridged adenosine
gcttcccagaggga

SEQ ID NO: 383 - DNA, 14 bp, Homo sapiens
agctgtcaatatcc

SEQ ID NO: 384 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged guanosine
  MOD_RES (3)..(3): May be a 2 prime O, 4 prime C methylene bridged cytidine
  MOD_RES (7)..(7): May be a 2 prime O methyl deoxycytidine
  MOD_RES (12)..(12): May be a 2 prime O, 4 prime C methylene bridged thymidine
  MOD_RES (13)..(13): May be a 2 prime O, 4 prime C methylene bridged cytidine
  MOD_RES (14)..(14): May be a 2 prime O, 4 prime C methylene bridged cytidine
agctgtcaatatcc

SEQ ID NO: 385 - DNA, 14 bp, Homo sapiens
tagctgtcaatatc

SEQ ID NO: 386 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged adenosine
  MOD_RES (3)..(3): May be a 2 prime O, 4 prime C methylene bridged guanosine
  MOD_RES (4)..(4): May be a 2 prime O methyl deoxycytidine
  MOD_RES (8)..(8): May be a 2 prime O methyl deoxycytidine
  MOD_RES (12)..(12): May be a 2 prime O, 4 prime C methylene bridged adenosine
  MOD_RES (13)..(13): May be a 2 prime O, 4 prime C methylene bridged thymidine
  MOD_RES (14)..(14): May be a 2 prime O, 4 prime C methylene bridged cytidine
tagctgtcaatatc

SEQ ID NO: 387 - DNA, 14 bp, Homo sapiens
atagctgtcaatat

SEQ ID NO: 388 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged thymidine
  MOD_RES (3)..(3): May be a 2 prime O, 4 prime C methylene bridged adenosine
  MOD_RES (5)..(5): May be a 2 prime O methyl deoxycytidine
  MOD_RES (9)..(9): May be a 2 prime O methyl deoxycytidine
  MOD_RES (12)..(12): May be a 2 prime O, 4 prime C methylene bridged thymidine
  MOD_RES (13)..(13): May be a 2 prime O, 4 prime C methylene bridged adenosine
  MOD_RES (14)..(14): May be a 2 prime O, 4 prime C methylene bridged thymidine
atagctgtcaatat

SEQ ID NO: 389 - DNA, 14 bp, Homo sapiens
gatagctgtcaata

SEQ ID NO: 390 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged adenosine
  MOD_RES (3)..(3): May be a 2 prime O, 4 prime C methylene bridged thymidine
  MOD_RES (6)..(6): May be a 2 prime O methyl deoxycytidine
  MOD_RES (10)..(10): May be a 2 prime O methyl deoxycytidine
  MOD_RES (12)..(12): May be a 2 prime O, 4 prime C methylene bridged adenosine
  MOD_RES (13)..(13): May be a 2 prime O, 4 prime C methylene bridged thymidine
  MOD_RES (14)..(14): May be a 2 prime O, 4 prime C methylene bridged adenosine
gatagctgtcaata

SEQ ID NO: 391 - DNA, 14 bp, Homo sapiens
ctgagaggatctgg

SEQ ID NO: 392 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (2)..(2): May be a 2 prime O, 4 prime C methylene bridged thymidine
  MOD_RES (3)..(3): May be a 2 prime O, 4 prime C methylene bridged guanosine
  MOD_RES (11)..(11): May be a 2 prime O methyl deoxycytidine
  MOD_RES (12)..(12): May be a 2 prime O, 4 prime C methylene bridged thymidine
  MOD_RES (13)..(13): May be a 2 prime O, 4 prime C methylene bridged guanosine
  MOD_RES (14)..(14): May be a 2 prime O, 4 prime C methylene bridged guanosine
ctgagaggatctgg

SEQ ID NO: 393 - DNA, 14 bp, Homo sapiens
cctgagaggatctg

SEQ ID NO: 394 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (2)..(2): May be a 2 prime O, 4 prime C methylene bridged cytidine
  MOD_RES (3)..(3): May be a 2 prime O, 4 prime C methylene bridged thymidine
  MOD_RES (12)..(12): May be a 2 prime O, 4 prime C methylene bridged cytidine
  MOD_RES (13)..(13): May be a 2 prime O, 4 prime C methylene bridged thymidine
  MOD_RES (14)..(14): May be a 2 prime O, 4 prime C methylene bridged guanosine
cctgagaggatctg

SEQ ID NO: 395 - DNA, 14 bp, Homo sapiens
agacagaagcagca

SEQ ID NO: 396 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged guanosine
  MOD_RES (3)..(3): May be a 2 prime O, 4 prime C methylene bridged adenosine
  MOD_RES (4)..(4): May be a 2 prime O methyl deoxycytidine
  MOD_RES (10)..(10): May be a 2 prime O methyl deoxycytidine
  MOD_RES (12)..(12): May be a 2 prime O, 4 prime C methylene bridged guanosine
  MOD_RES (13)..(13): May be a 2 prime O, 4 prime C methylene bridged cytidine
  MOD_RES (14)..(14): May be a 2 prime O, 4 prime C methylene bridged adenosine
agacagaagcagca

SEQ ID NO: 397 - DNA, 14 bp, Homo sapiens
tagacagaagcagc

SEQ ID NO: 398 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged adenosine
  MOD_RES (3)..(3): May be a 2 prime O, 4 prime C methylene bridged guanosine
  MOD_RES (5)..(5): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged adenosine
  MOD_RES (13)..(13): May be a 2 prime O, 4 prime C methylene bridged guanosine
  MOD_RES (14)..(14): May be a 2 prime O, 4 prime C methylene bridged cytidine
tagacagaagcagc

SEQ ID NO: 399 - DNA, 14 bp, Homo sapiens
atagacagaagcag

SEQ ID NO: 400 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged thymidine
  MOD_RES (3)..(3): May be a 2 prime O, 4 prime C methylene bridged adenosine
  MOD_RES (6)..(6): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged adenosine
  MOD_RES (14)..(14): May be a 2 prime O, 4 prime C methylene bridged guanosine
atagacagaagcag

SEQ ID NO: 401 - DNA, 14 bp, Homo sapiens
catagacagaagca

SEQ ID NO: 402 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (2)..(2): May be a 2 prime O, 4 prime C methylene bridged adenosine
  MOD_RES (3)..(3): May be a 2 prime O, 4 prime C methylene bridged thymidine
  MOD_RES (7)..(7): May be a 2 prime O methyl deoxycytidine
  MOD_RES (12)..(12): May be a 2 prime O, 4 prime C methylene bridged guanosine
  MOD_RES (13)..(13): May be a 2 prime O, 4 prime C methylene bridged cytidine
  MOD_RES (14)..(14): May be a 2 prime O, 4 prime C methylene bridged adenosine
catagacagaagca

SEQ ID NO: 403 - DNA, 14 bp, Homo sapiens
tcatagacagaagc

SEQ ID NO: 404 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged cytidine
  MOD_RES (3)..(3): May be a 2 prime O, 4 prime C methylene bridged adenosine
  MOD_RES (8)..(8): May be a 2 prime O methyl deoxycytidine
  MOD_RES (12)..(12): May be a 2 prime O, 4 prime C methylene bridged adenosine
  MOD_RES (13)..(13): May be a 2 prime O, 4 prime C methylene bridged guanosine
  MOD_RES (14)..(14): May be a 2 prime O, 4 prime C methylene bridged cytidine
tcatagacagaagc

SEQ ID NO: 405 - DNA, 14 bp, Homo sapiens
ttcatagacagaag

SEQ ID NO: 406 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged thymidine
  MOD_RES (3)..(3): May be a 2 prime O, 4 prime C methylene bridged cytidine
  MOD_RES (9)..(9): May be a 2 prime O methyl deoxycytidine
  MOD_RES (12)..(12): May be a 2 prime O, 4 prime C methylene bridged adenosine
  MOD_RES (13)..(13): May be a 2 prime O, 4 prime C methylene bridged adenosine
  MOD_RES (14)..(14): May be a 2 prime O, 4 prime C methylene bridged guanosine
ttcatagacagaag

SEQ ID NO: 407 - DNA, 14 bp, Homo sapiens
gttcatagacagaa

SEQ ID NO: 408 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged thymidine
  MOD_RES (3)..(3): May be a 2 prime O, 4 prime C methylene bridged thymidine
  MOD_RES (4)..(4): May be a 2 prime O methyl deoxycytidine
  MOD_RES (10)..(10): May be a 2 prime O methyl deoxycytidine
  MOD_RES (12)..(12): May be a 2 prime O, 4 prime C methylene bridged guanosine
  MOD_RES (13)..(13): May be a 2 prime O, 4 prime C methylene bridged adenosine
  MOD_RES (14)..(14): May be a 2 prime O, 4 prime C methylene bridged adenosine
gttcatagacagaa

SEQ ID NO: 409 - DNA, 14 bp, Homo sapiens
ggttcatagacaga

SEQ ID NO: 410 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged guanosine
  MOD_RES (3)..(3): May be a 2 prime O, 4 prime C methylene bridged thymidine
  MOD_RES (5)..(5): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged adenosine
  MOD_RES (13)..(13): May be a 2 prime O, 4 prime C methylene bridged guanosine
  MOD_RES (14)..(14): May be a 2 prime O, 4 prime C methylene bridged adenosine
ggttcatagacaga

SEQ ID NO: 411 - DNA, 14 bp, Homo sapiens
gggttcatagacag

SEQ ID NO: 412 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged guanosine
  MOD_RES (3)..(3): May be a 2 prime O, 4 prime C methylene bridged guanosine
  MOD_RES (6)..(6): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged adenosine
  MOD_RES (14)..(14): May be a 2 prime O, 4 prime C methylene bridged guanosine
gggttcatagacag

SEQ ID NO: 413 - DNA, 14 bp, Homo sapiens
ccccatcattcatg

SEQ ID NO: 414 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (2)..(2): May be a 2 prime O, 4 prime C methylene bridged cytidine
  MOD_RES (3)..(3): May be a 2 prime O, 4 prime C methylene bridged cytidine
  MOD_RES (4)..(4): May be a 2 prime O methyl deoxycytidine
  MOD_RES (7)..(7): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged adenosine
  MOD_RES (13)..(13): May be a 2 prime O, 4 prime C methylene bridged thymidine
  MOD_RES (14)..(14): May be a 2 prime O, 4 prime C methylene bridged guanosine
ccccatcattcatg

SEQ ID NO: 415 - DNA, 14 bp, Homo sapiens
ttatagcaggcaca

SEQ ID NO: 416 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged thymidine
  MOD_RES (3)..(3): May be a 2 prime O, 4 prime C methylene bridged adenosine
  MOD_RES (7)..(7): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged adenosine
  MOD_RES (13)..(13): May be a 2 prime O, 4 prime C methylene bridged cytidine
  MOD_RES (14)..(14): May be a 2 prime O, 4 prime C methylene bridged adenosine
ttatagcaggcaca

SEQ ID NO: 417 - DNA, 14 bp, Homo sapiens
cttatagcaggcac

SEQ ID NO: 418 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (2)..(2): May be a 2 prime O, 4 prime C methylene bridged thymidine
  MOD_RES (3)..(3): May be a 2 prime O, 4 prime C methylene bridged thymidine
  MOD_RES (8)..(8): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged adenosine
  MOD_RES (14)..(14): May be a 2 prime O, 4 prime C methylene bridged cytidine
cttatagcaggcac

SEQ ID NO: 419 - DNA, 14 bp, Homo sapiens
tcttatagcaggca

SEQ ID NO: 420 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged cytidine
  MOD_RES (3)..(3): May be a 2 prime O, 4 prime C methylene bridged thymidine
  MOD_RES (9)..(9): May be a 2 prime O methyl deoxycytidine
  MOD_RES (12)..(12): May be a 2 prime O, 4 prime C methylene bridged guanosine
  MOD_RES (13)..(13): May be a 2 prime O, 4 prime C methylene bridged cytidine
  MOD_RES (14)..(14): May be a 2 prime O, 4 prime C methylene bridged adenosine
tcttatagcaggca

SEQ ID NO: 421 - DNA, 14 bp, Homo sapiens
gatcttatagcagg

SEQ ID NO: 422 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged adenosine
  MOD_RES (3)..(3): May be a 2 prime O, 4 prime C methylene bridged thymidine
  MOD_RES (4)..(4): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged adenosine
  MOD_RES (13)..(13): May be a 2 prime O, 4 prime C methylene bridged guanosine
  MOD_RES (14)..(14): May be a 2 prime O, 4 prime C methylene bridged guanosine
gatcttatagcagg

SEQ ID NO: 423 - DNA, 14 bp, Homo sapiens
aaagtgcaggaggg

SEQ ID NO: 424 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged adenosine
  MOD_RES (3)..(3): May be a 2 prime O, 4 prime C methylene bridged adenosine
  MOD_RES (7)..(7): May be a 2 prime O methyl deoxycytidine
  MOD_RES (12)..(12): May be a 2 prime O, 4 prime C methylene bridged guanosine
  MOD_RES (13)..(13): May be a 2 prime O, 4 prime C methylene bridged guanosine
  MOD_RES (14)..(14): May be a 2 prime O, 4 prime C methylene bridged guanosine
aaagtgcaggaggg

SEQ ID NO: 425 - DNA, 14 bp, Homo sapiens
ttgccaaagtgcag

SEQ ID NO: 426 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged thymidine
  MOD_RES (3)..(3): May be a 2 prime O, 4 prime C methylene bridged guanosine
  MOD_RES (4)..(4): May be a 2 prime O methyl deoxycytidine
  MOD_RES (5)..(5): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged adenosine
  MOD_RES (14)..(14): May be a 2 prime O, 4 prime C methylene bridged guanosine
ttgccaaagtgcag

SEQ ID NO: 427 - DNA, 14 bp, Homo sapiens
aaaggcctttgagg

SEQ ID NO: 428 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged adenosine
  MOD_RES (3)..(3): May be a 2 prime O, 4 prime C methylene bridged adenosine
  MOD_RES (6)..(6): May be a 2 prime O methyl deoxycytidine
  MOD_RES (7)..(7): May be a 2 prime O methyl deoxycytidine
  MOD_RES (12)..(12): May be a 2 prime O, 4 prime C methylene bridged adenosine
  MOD_RES (13)..(13): May be a 2 prime O, 4 prime C methylene bridged guanosine
  MOD_RES (14)..(14): May be a 2 prime O, 4 prime C methylene bridged guanosine
aaaggcctttgagg

SEQ ID NO: 429 - DNA, 14 bp, Homo sapiens
aaaaggcctttgag

SEQ ID NO: 430 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged adenosine
  MOD_RES (3)..(3): May be a 2 prime O, 4 prime C methylene bridged adenosine
  MOD_RES (7)..(7): May be a 2 prime O methyl deoxycytidine
  MOD_RES (8)..(8): May be a 2 prime O methyl deoxycytidine
  MOD_RES (12)..(12): May be a 2 prime O, 4 prime C methylene bridged guanosine
  MOD_RES (13)..(13): May be a 2 prime O, 4 prime C methylene bridged adenosine
  MOD_RES (14)..(14): May be a 2 prime O, 4 prime C methylene bridged guanosine
aaaaggcctttgag

SEQ ID NO: 431 - DNA, 14 bp, Homo sapiens
caaaaggcctttga

SEQ ID NO: 432 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (2)..(2): May be a 2 prime O, 4 prime C methylene bridged adenosine
  MOD_RES (3)..(3): May be a 2 prime O, 4 prime C methylene bridged adenosine
  MOD_RES (8)..(8): May be a 2 prime O methyl deoxycytidine
  MOD_RES (9)..(9): May be a 2 prime O methyl deoxycytidine
  MOD_RES (12)..(12): May be a 2 prime O, 4 prime C methylene bridged thymidine
  MOD_RES (13)..(13): May be a 2 prime O, 4 prime C methylene bridged guanosine
  MOD_RES (14)..(14): May be a 2 prime O, 4 prime C methylene bridged adenosine
caaaaggcctttga

SEQ ID NO: 433 - DNA, 14 bp, Homo sapiens
gcaaaaggcctttg

SEQ ID NO: 434 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged cytidine
  MOD_RES (3)..(3): May be a 2 prime O, 4 prime C methylene bridged adenosine
  MOD_RES (9)..(9): May be a 2 prime O methyl deoxycytidine
  MOD_RES (10)..(10): May be a 2 prime O methyl deoxycytidine
  MOD_RES (12)..(12): May be a 2 prime O, 4 prime C methylene bridged thymidine
  MOD_RES (13)..(13): May be a 2 prime O, 4 prime C methylene bridged thymidine
  MOD_RES (14)..(14): May be a 2 prime O, 4 prime C methylene bridged guanosine
gcaaaaggcctttg

SEQ ID NO: 435 - DNA, 14 bp, Homo sapiens
tgcaaaaggccttt

SEQ ID NO: 436 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged guanosine
  MOD_RES (3)..(3): May be a 2 prime O, 4 prime C methylene bridged cytidine
  MOD_RES (10)..(10): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged thymidine
  MOD_RES (13)..(13): May be a 2 prime O, 4 prime C methylene bridged thymidine
  MOD_RES (14)..(14): May be a 2 prime O, 4 prime C methylene bridged thymidine
tgcaaaaggccttt

SEQ ID NO: 437 - DNA, 14 bp, Homo sapiens
gtgcaaaaggcctt

SEQ ID NO: 438 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged thymidine
  MOD_RES (3)..(3): May be a 2 prime O, 4 prime C methylene bridged guanosine
  MOD_RES (4)..(4): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged thymidine
  MOD_RES (14)..(14): May be a 2 prime O, 4 prime C methylene bridged thymidine
gtgcaaaaggcctt

SEQ ID NO: 439 - DNA, 14 bp, Homo sapiens
ggtgcaaaaggcct

SEQ ID NO: 440 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged guanosine
  MOD_RES (3)..(3): May be a 2 prime O, 4 prime C methylene bridged thymidine
  MOD_RES (5)..(5): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged cytidine
  MOD_RES (14)..(14): May be a 2 prime O, 4 prime C methylene bridged thymidine
ggtgcaaaaggcct

SEQ ID NO: 441 - DNA, 14 bp, Homo sapiens
gggtgcaaaaggcc

SEQ ID NO: 442 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged guanosine
  MOD_RES (3)..(3): May be a 2 prime O, 4 prime C methylene bridged guanosine
  MOD_RES (6)..(6): May be a 2 prime O methyl deoxycytidine
  MOD_RES (12)..(12): May be a 2 prime O, 4 prime C methylene bridged guanosine
  MOD_RES (13)..(13): May be a 2 prime O, 4 prime C methylene bridged cytidine
  MOD_RES (14)..(14): May be a 2 prime O, 4 prime C methylene bridged cytidine
gggtgcaaaaggcc

SEQ ID NO: 443 - DNA, 14 bp, Homo sapiens
gtcataggtggcct

SEQ ID NO: 444 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged thymidine
  MOD_RES (3)..(3): May be a 2 prime O, 4 prime C methylene bridged cytidine
  MOD_RES (12)..(12): May be a 2 prime O, 4 prime C methylene bridged cytidine
  MOD_RES (13)..(13): May be a 2 prime O, 4 prime C methylene bridged cytidine
  MOD_RES (14)..(14): May be a 2 prime O, 4 prime C methylene bridged thymidine
gtcataggtggcct

SEQ ID NO: 445 - DNA, 14 bp, Homo sapiens
ggtcataggtggcc

SEQ ID NO: 446 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged guanosine
  MOD_RES (3)..(3): May be a 2 prime O, 4 prime C methylene bridged thymidine
  MOD_RES (4)..(4): May be a 2 prime O methyl deoxycytidine
  MOD_RES (12)..(12): May be a 2 prime O, 4 prime C methylene bridged guanosine
  MOD_RES (13)..(13): May be a 2 prime O, 4 prime C methylene bridged cytidine
  MOD_RES (14)..(14): May be a 2 prime O, 4 prime C methylene bridged cytidine
ggtcataggtggcc

SEQ ID NO: 447 - DNA, 14 bp, Homo sapiens
ccacctgaacagcc

SEQ ID NO: 448 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (2)..(2): May be a 2 prime O, 4 prime C methylene bridged cytidine
  MOD_RES (3)..(3): May be a 2 prime O, 4 prime C methylene bridged adenosine
  MOD_RES (4)..(4): May be a 2 prime O methyl deoxycytidine
  MOD_RES (5)..(5): May be a 2 prime O methyl deoxycytidine
  MOD_RES (10)..(10): May be a 2 prime O methyl deoxycytidine
  MOD_RES (12)..(12): May be a 2 prime O, 4 prime C methylene bridged guanosine
  MOD_RES (13)..(13): May be a 2 prime O, 4 prime C methylene bridged cytidine
  MOD_RES (14)..(14): May be a 2 prime O, 4 prime C methylene bridged cytidine
ccacctgaacagcc

SEQ ID NO: 449 - DNA, 14 bp, Homo sapiens
gccacctgaacagc

SEQ ID NO: 450 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged cytidine
  MOD_RES (3)..(3): May be a 2 prime O, 4 prime C methylene bridged cytidine
  MOD_RES (5)..(5): May be a 2 prime O methyl deoxycytidine
  MOD_RES (6)..(6): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged adenosine
  MOD_RES (13)..(13): May be a 2 prime O, 4 prime C methylene bridged guanosine
  MOD_RES (14)..(14): May be a 2 prime O, 4 prime C methylene bridged cytidine
gccacctgaacagc

SEQ ID NO: 451 - DNA, 14 bp, Homo sapiens
gacaccagccacct

SEQ ID NO: 452 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged adenosine
  MOD_RES (3)..(3): May be a 2 prime O, 4 prime C methylene bridged cytidine
  MOD_RES (5)..(5): May be a 2 prime O methyl deoxycytidine
  MOD_RES (6)..(6): May be a 2 prime O methyl deoxycytidine
  MOD_RES (9)..(9): May be a 2 prime O methyl deoxycytidine
  MOD_RES (10)..(10): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged cytidine
  MOD_RES (14)..(14): May be a 2 prime O, 4 prime C methylene bridged thymidine
gacaccagccacct

SEQ ID NO: 453 - DNA, 14 bp, Homo sapiens
tgtccagggtctgg

SEQ ID NO: 454 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged guanosine
  MOD_RES (3)..(3): May be a 2 prime O, 4 prime C methylene bridged thymidine
  MOD_RES (4)..(4): May be a 2 prime O methyl deoxycytidine
  MOD_RES (5)..(5): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged thymidine
  MOD_RES (13)..(13): May be a 2 prime O, 4 prime C methylene bridged guanosine
  MOD_RES (14)..(14): May be a 2 prime O, 4 prime C methylene bridged guanosine
tgtccagggtctgg

SEQ ID NO: 455 - DNA, 14 bp, Homo sapiens
gtgtccagggtctg

SEQ ID NO: 456 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged thymidine
  MOD_RES (3)..(3): May be a 2 prime O, 4 prime C methylene bridged guanosine
  MOD_RES (5)..(5): May be a 2 prime O methyl deoxycytidine
  MOD_RES (6)..(6): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged thymidine
  MOD_RES (14)..(14): May be a 2 prime O, 4 prime C methylene bridged guanosine
gtgtccagggtctg

SEQ ID NO: 457 - DNA, 14 bp, Homo sapiens
tgtgtccagggtct

SEQ ID NO: 458 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged guanosine
  MOD_RES (3)..(3): May be a 2 prime O, 4 prime C methylene bridged thymidine
  MOD_RES (6)..(6): May be a 2 prime O methyl deoxycytidine
  MOD_RES (7)..(7): May be a 2 prime O methyl deoxycytidine
  MOD_RES (12)..(12): May be a 2 prime O, 4 prime C methylene bridged thymidine
  MOD_RES (13)..(13): May be a 2 prime O, 4 prime C methylene bridged cytidine
  MOD_RES (14)..(14): May be a 2 prime O, 4 prime C methylene bridged thymidine
tgtgtccagggtct

SEQ ID NO: 459 - DNA, 14 bp, Homo sapiens
tgggtgacttcccc

SEQ ID NO: 460 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged guanosine
  MOD_RES (3)..(3): May be a 2 prime O, 4 prime C methylene bridged guanosine
  MOD_RES (8)..(8): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged cytidine
  MOD_RES (14)..(14): May be a 2 prime O, 4 prime C methylene bridged cytidine
tgggtgacttcccc

SEQ ID NO: 461 - DNA, 14 bp, Homo sapiens
ttgggtgacttccc

SEQ ID NO: 462 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged thymidine
  MOD_RES (3)..(3): May be a 2 prime O, 4 prime C methylene bridged guanosine
  MOD_RES (9)..(9): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged cytidine
  MOD_RES (14)..(14): May be a 2 prime O, 4 prime C methylene bridged cytidine
ttgggtgacttccc

SEQ ID NO: 463 - DNA, 14 bp, Homo sapiens
attgggtgacttcc

SEQ ID NO: 464 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged thymidine
  MOD_RES (3)..(3): May be a 2 prime O, 4 prime C methylene bridged thymidine
  MOD_RES (10)..(10): May be a 2 prime O methyl deoxycytidine
  MOD_RES (12)..(12): May be a 2 prime O, 4 prime C methylene bridged thymidine
  MOD_RES (13)..(13): May be a 2 prime O, 4 prime C methylene bridged cytidine
  MOD_RES (14)..(14): May be a 2 prime O, 4 prime C methylene bridged cytidine
attgggtgacttcc

SEQ ID NO: 465 - DNA, 14 bp, Homo sapiens
gctggaaattgggt

SEQ ID NO: 466 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged cytidine
  MOD_RES (3)..(3): May be a 2 prime O, 4 prime C methylene bridged thymidine
  MOD_RES (12)..(12): May be a 2 prime O, 4 prime C methylene bridged guanosine
  MOD_RES (13)..(13): May be a 2 prime O, 4 prime C methylene bridged guanosine
  MOD_RES (14)..(14): May be a 2 prime O, 4 prime C methylene bridged thymidine
gctggaaattgggt

SEQ ID NO: 467 - DNA, 14 bp, Homo sapiens
ctgtaaggcaccac

SEQ ID NO: 468 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (2)..(2): May be a 2 prime O, 4 prime C methylene bridged thymidine
  MOD_RES (3)..(3): May be a 2 prime O, 4 prime C methylene bridged guanosine
  MOD_RES (9)..(9): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged adenosine
  MOD_RES (14)..(14): May be a 2 prime O, 4 prime C methylene bridged cytidine
ctgtaaggcaccac

SEQ ID NO: 469 - DNA, 14 bp, Homo sapiens
gctgtaaggcacca

SEQ ID NO: 470 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged cytidine
  MOD_RES (3)..(3): May be a 2 prime O, 4 prime C methylene bridged thymidine
  MOD_RES (10)..(10): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged cytidine
  MOD_RES (14)..(14): May be a 2 prime O, 4 prime C methylene bridged adenosine
gctgtaaggcacca

SEQ ID NO: 471 - DNA, 14 bp, Homo sapiens
tgctgtaaggcacc

SEQ ID NO: 472 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged guanosine
  MOD_RES (3)..(3): May be a 2 prime O, 4 prime C methylene bridged cytidine
  MOD_RES (11)..(11): May be a 2 prime O methyl deoxycytidine
  MOD_RES (12)..(12): May be a 2 prime O, 4 prime C methylene bridged adenosine
  MOD_RES (13)..(13): May be a 2 prime O, 4 prime C methylene bridged cytidine
  MOD_RES (14)..(14): May be a 2 prime O, 4 prime C methylene bridged cytidine
tgctgtaaggcacc

SEQ ID NO: 473 - DNA, 14 bp, Homo sapiens
attctgtgacttct

SEQ ID NO: 474 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged thymidine
  MOD_RES (3)..(3): May be a 2 prime O, 4 prime C methylene bridged thymidine
  MOD_RES (4)..(4): May be a 2 prime O methyl deoxycytidine
  MOD_RES (10)..(10): May be a 2 prime O methyl deoxycytidine
  MOD_RES (12)..(12): May be a 2 prime O, 4 prime C methylene bridged thymidine
  MOD_RES (13)..(13): May be a 2 prime O, 4 prime C methylene bridged cytidine
  MOD_RES (14)..(14): May be a 2 prime O, 4 prime C methylene bridged thymidine
attctgtgacttct

SEQ ID NO: 475 - DNA, 14 bp, Homo sapiens
tattctgtgacttc

SEQ ID NO: 476 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged adenosine
  MOD_RES (3)..(3): May be a 2 prime O, 4 prime C methylene bridged thymidine
  MOD_RES (5)..(5): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged thymidine
  MOD_RES (13)..(13): May be a 2 prime O, 4 prime C methylene bridged thymidine
  MOD_RES (14)..(14): May be a 2 prime O, 4 prime C methylene bridged cytidine
tattctgtgacttc

SEQ ID NO: 477 - DNA, 14 bp, Homo sapiens
ctattctgtgactt

SEQ ID NO: 478 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (2)..(2): May be a 2 prime O, 4 prime C methylene bridged thymidine
  MOD_RES (3)..(3): May be a 2 prime O, 4 prime C methylene bridged adenosine
  MOD_RES (6)..(6): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged thymidine
  MOD_RES (14)..(14): May be a 2 prime O, 4 prime C methylene bridged thymidine
ctattctgtgactt

SEQ ID NO: 479 - DNA, 14 bp, Homo sapiens
cctattctgtgact

SEQ ID NO: 480 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (2)..(2): May be a 2 prime O, 4 prime C methylene bridged cytidine
  MOD_RES (3)..(3): May be a 2 prime O, 4 prime C methylene bridged thymidine
  MOD_RES (7)..(7): May be a 2 prime O methyl deoxycytidine
  MOD_RES (12)..(12): May be a 2 prime O, 4 prime C methylene bridged adenosine
  MOD_RES (13)..(13): May be a 2 prime O, 4 prime C methylene bridged cytidine
  MOD_RES (14)..(14): May be a 2 prime O, 4 prime C methylene bridged thymidine
cctattctgtgact

SEQ ID NO: 481 - DNA, 14 bp, Homo sapiens
gcctattctgtgac

SEQ ID NO: 482 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged cytidine
  MOD_RES (3)..(3): May be a 2 prime O, 4 prime C methylene bridged cytidine
  MOD_RES (8)..(8): May be a 2 prime O methyl deoxycytidine
  MOD_RES (12)..(12): May be a 2 prime O, 4 prime C methylene bridged guanosine
  MOD_RES (13)..(13): May be a 2 prime O, 4 prime C methylene bridged adenosine
  MOD_RES (14)..(14): May be a 2 prime O, 4 prime C methylene bridged cytidine
gcctattctgtgac

SEQ ID NO: 483 - DNA, 14 bp, Homo sapiens
agcctattctgtga

SEQ ID NO: 484 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged guanosine
  MOD_RES (3)..(3): May be a 2 prime O, 4 prime C methylene bridged cytidine
  MOD_RES (4)..(4): May be a 2 prime O methyl deoxycytidine
  MOD_RES (9)..(9): May be a 2 prime O methyl deoxycytidine
  MOD_RES (12)..(12): May be a 2 prime O, 4 prime C methylene bridged thymidine
  MOD_RES (13)..(13): May be a 2 prime O, 4 prime C methylene bridged guanosine
  MOD_RES (14)..(14): May be a 2 prime O, 4 prime C methylene bridged adenosine
agcctattctgtga

SEQ ID NO: 485 - DNA, 14 bp, Homo sapiens
gagcctattctgtg

SEQ ID NO: 486 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged adenosine
  MOD_RES (3)..(3): May be a 2 prime O, 4 prime C methylene bridged guanosine
  MOD_RES (4)..(4): May be a 2 prime O methyl deoxycytidine
  MOD_RES (5)..(5): May be a 2 prime O methyl deoxycytidine
  MOD_RES (10)..(10): May be a 2 prime O methyl deoxycytidine
  MOD_RES (12)..(12): May be a 2 prime O, 4 prime C methylene bridged guanosine
  MOD_RES (13)..(13): May be a 2 prime O, 4 prime C methylene bridged thymidine
  MOD_RES (14)..(14): May be a 2 prime O, 4 prime C methylene bridged guanosine
gagcctattctgtg

SEQ ID NO: 487 - DNA, 14 bp, Homo sapiens
ggagcctattctgt

SEQ ID NO: 488 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged guanosine
  MOD_RES (3)..(3): May be a 2 prime O, 4 prime C methylene bridged adenosine
  MOD_RES (5)..(5): May be a 2 prime O methyl deoxycytidine
  MOD_RES (6)..(6): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged thymidine
  MOD_RES (13)..(13): May be a 2 prime O, 4 prime C methylene bridged guanosine
  MOD_RES (14)..(14): May be a 2 prime O, 4 prime C methylene bridged thymidine
ggagcctattctgt

SEQ ID NO: 489 - DNA, 14 bp, Homo sapiens
aggagcctattctg

SEQ ID NO: 490 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged guanosine
  MOD_RES (3)..(3): May be a 2 prime O, 4 prime C methylene bridged guanosine
  MOD_RES (6)..(6): May be a 2 prime O methyl deoxycytidine
  MOD_RES (7)..(7): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged thymidine
  MOD_RES (14)..(14): May be a 2 prime O, 4 prime C methylene bridged guanosine
aggagcctattctg

SEQ ID NO: 491 - DNA, 14 bp, Homo sapiens
caggagcctattct

SEQ ID NO: 492 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (2)..(2): May be a 2 prime O, 4 prime C methylene bridged adenosine
  MOD_RES (3)..(3): May be a 2 prime O, 4 prime C methylene bridged guanosine
  MOD_RES (7)..(7): May be a 2 prime O methyl deoxycytidine
  MOD_RES (8)..(8): May be a 2 prime O methyl deoxycytidine
  MOD_RES (12)..(12): May be a 2 prime O, 4 prime C methylene bridged thymidine
  MOD_RES (13)..(13): May be a 2 prime O, 4 prime C methylene bridged cytidine
  MOD_RES (14)..(14): May be a 2 prime O, 4 prime C methylene bridged thymidine
caggagcctattct

SEQ ID NO: 493 - DNA, 14 bp, Homo sapiens
ccaggagcctattc

SEQ ID NO: 494 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (2)..(2): May be a 2 prime O, 4 prime C methylene bridged cytidine
  MOD_RES (3)..(3): May be a 2 prime O, 4 prime C methylene bridged adenosine
  MOD_RES (8)..(8): May be a 2 prime O methyl deoxycytidine
  MOD_RES (9)..(9): May be a 2 prime O methyl deoxycytidine
  MOD_RES (12)..(12): May be a 2 prime O, 4 prime C methylene bridged thymidine
  MOD_RES (13)..(13): May be a 2 prime O, 4 prime C methylene bridged thymidine
  MOD_RES (14)..(14): May be a 2 prime O, 4 prime C methylene bridged cytidine
ccaggagcctattc

SEQ ID NO: 495 - DNA, 14 bp, Homo sapiens
gccaggagcctatt

SEQ ID NO: 496 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged cytidine
  MOD_RES (3)..(3): May be a 2 prime O, 4 prime C methylene bridged cytidine
  MOD_RES (9)..(9): May be a 2 prime O methyl deoxycytidine
  MOD_RES (10)..(10): May be a 2 prime O methyl deoxycytidine
  MOD_RES (12)..(12): May be a 2 prime O, 4 prime C methylene bridged adenosine
  MOD_RES (13)..(13): May be a 2 prime O, 4 prime C methylene bridged thymidine
  MOD_RES (14)..(14): May be a 2 prime O, 4 prime C methylene bridged thymidine
gccaggagcctatt

SEQ ID NO: 497 - DNA, 14 bp, Homo sapiens
tctcatagagagtc

SEQ ID NO: 498 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged cytidine
  MOD_RES (3)..(3): May be a 2 prime O, 4 prime C methylene bridged thymidine
  MOD_RES (4)..(4): May be a 2 prime O methyl deoxycytidine
  MOD_RES (12)..(12): May be a 2 prime O, 4 prime C methylene bridged guanosine
  MOD_RES (13)..(13): May be a 2 prime O, 4 prime C methylene bridged thymidine
  MOD_RES (14)..(14): May be a 2 prime O, 4 prime C methylene bridged cytidine
tctcatagagagtc

SEQ ID NO: 499 - DNA, 14 bp, Homo sapiens
ttctcatagagagt

SEQ ID NO: 500 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged thymidine
  MOD_RES (3)..(3): May be a 2 prime O, 4 prime C methylene bridged cytidine
  MOD_RES (5)..(5): May be a 2 prime O methyl deoxycytidine
  MOD_RES (12)..(12): May be a 2 prime O, 4 prime C methylene bridged adenosine
  MOD_RES (13)..(13): May be a 2 prime O, 4 prime C methylene bridged guanosine
  MOD_RES (14)..(14): May be a 2 prime O, 4 prime C methylene bridged thymidine
ttctcatagagagt

SEQ ID NO: 501 - DNA, 14 bp, Homo sapiens
tggagcaggagccc

SEQ ID NO: 502 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged guanosine
  MOD_RES (3)..(3): May be a 2 prime O, 4 prime C methylene bridged guanosine
  MOD_RES (6)..(6): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged cytidine
  MOD_RES (14)..(14): May be a 2 prime O, 4 prime C methylene bridged cytidine
tggagcaggagccc

SEQ ID NO: 503 - DNA, 14 bp, Homo sapiens
gtggagcaggagcc

SEQ ID NO: 504 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged thymidine
  MOD_RES (3)..(3): May be a 2 prime O, 4 prime C methylene bridged guanosine
  MOD_RES (7)..(7): May be a 2 prime O methyl deoxycytidine
  MOD_RES (12)..(12): May be a 2 prime O, 4 prime C methylene bridged guanosine
  MOD_RES (13)..(13): May be a 2 prime O, 4 prime C methylene bridged cytidine
  MOD_RES (14)..(14): May be a 2 prime O, 4 prime C methylene bridged cytidine
gtggagcaggagcc

SEQ ID NO: 505 - DNA, 14 bp, Homo sapiens
tgctgccttcttac

SEQ ID NO: 506 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged guanosine
  MOD_RES (3)..(3): May be a 2 prime O, 4 prime C methylene bridged cytidine
  MOD_RES (6)..(6): May be a 2 prime O methyl deoxycytidine
  MOD_RES (7)..(7): May be a 2 prime O methyl deoxycytidine
  MOD_RES (10)..(10): May be a 2 prime O methyl deoxycytidine
  MOD_RES (12)..(12): May be a 2 prime O, 4 prime C methylene bridged thymidine
  MOD_RES (13)..(13): May be a 2 prime O, 4 prime C methylene bridged adenosine
  MOD_RES (14)..(14): May be a 2 prime O, 4 prime C methylene bridged cytidine
tgctgccttcttac

SEQ ID NO: 507 - DNA, 14 bp, Homo sapiens
atgctgccttctta

SEQ ID NO: 508 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged thymidine
  MOD_RES (3)..(3): May be a 2 prime O, 4 prime C methylene bridged guanosine
  MOD_RES (4)..(4): May be a 2 prime O methyl deoxycytidine
  MOD_RES (7)..(7): May be a 2 prime O methyl deoxycytidine
  MOD_RES (8)..(8): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged thymidine
  MOD_RES (13)..(13): May be a 2 prime O, 4 prime C methylene bridged thymidine
  MOD_RES (14)..(14): May be a 2 prime O, 4 prime C methylene bridged adenosine
atgctgccttctta

SEQ ID NO: 509 - DNA, 14 bp, Homo sapiens
gatgctgccttctt

SEQ ID NO: 510 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged adenosine
  MOD_RES (3)..(3): May be a 2 prime O, 4 prime C methylene bridged thymidine
  MOD_RES (5)..(5): May be a 2 prime O methyl deoxycytidine
  MOD_RES (8)..(8): May be a 2 prime O methyl deoxycytidine
  MOD_RES (9)..(9): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged thymidine
  MOD_RES (14)..(14): May be a 2 prime O, 4 prime C methylene bridged thymidine
gatgctgccttctt

SEQ ID NO: 511 - DNA, 14 bp, Homo sapiens
agaaggcatccatg

SEQ ID NO: 512 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged guanosine
  MOD_RES (3)..(3): May be a 2 prime O, 4 prime C methylene bridged adenosine
  MOD_RES (7)..(7): May be a 2 prime O methyl deoxycytidine
  MOD_RES (10)..(10): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged adenosine
  MOD_RES (13)..(13): May be a 2 prime O, 4 prime C methylene bridged thymidine
  MOD_RES (14)..(14): May be a 2 prime O, 4 prime C methylene bridged guanosine
agaaggcatccatg

SEQ ID NO: 513 - DNA, 14 bp, Homo sapiens
aagaaggcatccat

SEQ ID NO: 514 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged adenosine
  MOD_RES (3)..(3): May be a 2 prime O, 4 prime C methylene bridged guanosine
  MOD_RES (8)..(8): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged adenosine
  MOD_RES (14)..(14): May be a 2 prime O, 4 prime C methylene bridged thymidine
aagaaggcatccat

SEQ ID NO: 515 - DNA, 14 bp, Homo sapiens
caagaaggcatcca

SEQ ID NO: 516 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (2)..(2): May be a 2 prime O, 4 prime C methylene bridged adenosine
  MOD_RES (3)..(3): May be a 2 prime O, 4 prime C methylene bridged adenosine
  MOD_RES (9)..(9): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged cytidine
  MOD_RES (14)..(14): May be a 2 prime O, 4 prime C methylene bridged adenosine
caagaaggcatcca

SEQ ID NO: 517 - DNA, 14 bp, Homo sapiens
caccaagaaggcat

SEQ ID NO: 518 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (2)..(2): May be a 2 prime O, 4 prime C methylene bridged adenosine
  MOD_RES (3)..(3): May be a 2 prime O, 4 prime C methylene bridged cytidine
  MOD_RES (4)..(4): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged adenosine
  MOD_RES (14)..(14): May be a 2 prime O, 4 prime C methylene bridged thymidine
caccaagaaggcat

SEQ ID NO: 519 - DNA, 14 bp, Homo sapiens
gcaccaagaaggca

SEQ ID NO: 520 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged cytidine
  MOD_RES (3)..(3): May be a 2 prime O, 4 prime C methylene bridged adenosine
  MOD_RES (4)..(4): May be a 2 prime O methyl deoxycytidine
  MOD_RES (5)..(5): May be a 2 prime O methyl deoxycytidine
  MOD_RES (12)..(12): May be a 2 prime O, 4 prime C methylene bridged guanosine
  MOD_RES (13)..(13): May be a 2 prime O, 4 prime C methylene bridged cytidine
  MOD_RES (14)..(14): May be a 2 prime O, 4 prime C methylene bridged adenosine
gcaccaagaaggca

SEQ ID NO: 521 - DNA, 14 bp, Homo sapiens
tagcaccaagaagg

SEQ ID NO: 522 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged adenosine
  MOD_RES (3)..(3): May be a 2 prime O, 4 prime C methylene bridged guanosine
  MOD_RES (4)..(4): May be a 2 prime O methyl deoxycytidine
  MOD_RES (6)..(6): May be a 2 prime O methyl deoxycytidine
  MOD_RES (7)..(7): May be a 2 prime O methyl deoxycytidine
  MOD_RES (12)..(12): May be a 2 prime O, 4 prime C methylene bridged adenosine
  MOD_RES (13)..(13): May be a 2 prime O, 4 prime C methylene bridged guanosine
  MOD_RES (14)..(14): May be a 2 prime O, 4 prime C methylene bridged guanosine
tagcaccaagaagg

SEQ ID NO: 523 - DNA, 14 bp, Homo sapiens
gtagcaccaagaag

SEQ ID NO: 524 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged thymidine
  MOD_RES (3)..(3): May be a 2 prime O, 4 prime C methylene bridged adenosine
  MOD_RES (5)..(5): May be a 2 prime O methyl deoxycytidine
  MOD_RES (7)..(7): May be a 2 prime O methyl deoxycytidine
  MOD_RES (8)..(8): May be a 2 prime O methyl deoxycytidine
  MOD_RES (12)..(12): May be a 2 prime O, 4 prime C methylene bridged adenosine
  MOD_RES (13)..(13): May be a 2 prime O, 4 prime C methylene bridged adenosine
  MOD_RES (14)..(14): May be a 2 prime O, 4 prime C methylene bridged guanosine
gtagcaccaagaag

SEQ ID NO: 525 - DNA, 14 bp, Homo sapiens
tgtagcaccaagaa

SEQ ID NO: 526 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged guanosine
  MOD_RES (3)..(3): May be a 2 prime O, 4 prime C methylene bridged thymidine
  MOD_RES (6)..(6): May be a 2 prime O methyl deoxycytidine
  MOD_RES (8)..(8): May be a 2 prime O methyl deoxycytidine
  MOD_RES (9)..(9): May be a 2 prime O methyl deoxycytidine
  MOD_RES (12)..(12): May be a 2 prime O, 4 prime C methylene bridged guanosine
  MOD_RES (13)..(13): May be a 2 prime O, 4 prime C methylene bridged adenosine
  MOD_RES (14)..(14): May be a 2 prime O, 4 prime C methylene bridged adenosine
tgtagcaccaagaa

SEQ ID NO: 527 - DNA, 14 bp, Homo sapiens
gtgtagcaccaaga

SEQ ID NO: 528 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged thymidine
  MOD_RES (3)..(3): May be a 2 prime O, 4 prime C methylene bridged guanosine
  MOD_RES (7)..(7): May be a 2 prime O methyl deoxycytidine
  MOD_RES (9)..(9): May be a 2 prime O methyl deoxycytidine
  MOD_RES (10)..(10): May be a 2 prime O methyl deoxycytidine
  MOD_RES (12)..(12): May be a 2 prime O, 4 prime C methylene bridged adenosine
  MOD_RES (13)..(13): May be a 2 prime O, 4 prime C methylene bridged guanosine
  MOD_RES (14)..(14): May be a 2 prime O, 4 prime C methylene bridged adenosine
gtgtagcaccaaga

SEQ ID NO: 529 - DNA, 14 bp, Homo sapiens
ggtgtagcaccaag

SEQ ID NO: 530 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged guanosine
  MOD_RES (3)..(3): May be a 2 prime O, 4 prime C methylene bridged thymidine
  MOD_RES (8)..(8): May be a 2 prime O methyl deoxycytidine
  MOD_RES (10)..(10): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged adenosine
  MOD_RES (13)..(13): May be a 2 prime O, 4 prime C methylene bridged adenosine
  MOD_RES (14)..(14): May be a 2 prime O, 4 prime C methylene bridged guanosine
ggtgtagcaccaag

SEQ ID NO: 531 - DNA, 14 bp, Homo sapiens
tggtgtagcaccaa

SEQ ID NO: 532 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged guanosine
  MOD_RES (3)..(3): May be a 2 prime O, 4 prime C methylene bridged guanosine
  MOD_RES (9)..(9): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged adenosine
  MOD_RES (14)..(14): May be a 2 prime O, 4 prime C methylene bridged adenosine
tggtgtagcaccaa

SEQ ID NO: 533 - DNA, 14 bp, Homo sapiens
gggatggcactggg

SEQ ID NO: 534 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged guanosine
  MOD_RES (3)..(3): May be a 2 prime O, 4 prime C methylene bridged guanosine
  MOD_RES (8)..(8): May be a 2 prime O methyl deoxycytidine
  MOD_RES (10)..(10): May be a 2 prime O methyl deoxycytidine
  MOD_RES (12)..(12): May be a 2 prime O, 4 prime C methylene bridged guanosine
  MOD_RES (13)..(13): May be a 2 prime O, 4 prime C methylene bridged guanosine
  MOD_RES (14)..(14): May be a 2 prime O, 4 prime C methylene bridged guanosine
gggatggcactggg

SEQ ID NO: 535 - DNA, 14 bp, Homo sapiens
gctgtccatgaagg

SEQ ID NO: 536 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged cytidine
  MOD_RES (3)..(3): May be a 2 prime O, 4 prime C methylene bridged thymidine
  MOD_RES (6)..(6): May be a 2 prime O methyl deoxycytidine
  MOD_RES (7)..(7): May be a 2 prime O methyl deoxycytidine
  MOD_RES (12)..(12): May be a 2 prime O, 4 prime C methylene bridged adenosine
  MOD_RES (13)..(13): May be a 2 prime O, 4 prime C methylene bridged guanosine
  MOD_RES (14)..(14): May be a 2 prime O, 4 prime C methylene bridged guanosine
gctgtccatgaagg

SEQ ID NO: 537 - DNA, 14 bp, Homo sapiens
gcctagaagcccag

SEQ ID NO: 538 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged cytidine
  MOD_RES (3)..(3): May be a 2 prime O, 4 prime C methylene bridged cytidine
  MOD_RES (10)..(10): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged adenosine
  MOD_RES (14)..(14): May be a 2 prime O, 4 prime C methylene bridged guanosine
gcctagaagcccag

SEQ ID NO: 539 - DNA, 14 bp, Homo sapiens
ggcattgaaggcac

SEQ ID NO: 540 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged guanosine
  MOD_RES (3)..(3): May be a 2 prime O, 4 prime C methylene bridged cytidine
  MOD_RES (12)..(12): May be a 2 prime O, 4 prime C methylene bridged cytidine
  MOD_RES (13)..(13): May be a 2 prime O, 4 prime C methylene bridged adenosine
  MOD_RES (14)..(14): May be a 2 prime O, 4 prime C methylene bridged cytidine
ggcattgaaggcac

SEQ ID NO: 541 - DNA, 14 bp, Homo sapiens
acttgatcagcaag

SEQ ID NO: 542 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged cytidine
  MOD_RES (3)..(3): May be a 2 prime O, 4 prime C methylene bridged thymidine
  MOD_RES (8)..(8): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged adenosine
  MOD_RES (13)..(13): May be a 2 prime O, 4 prime C methylene bridged adenosine
  MOD_RES (14)..(14): May be a 2 prime O, 4 prime C methylene bridged guanosine
acttgatcagcaag

SEQ ID NO: 543 - DNA, 14 bp, Homo sapiens
gacttgatcagcaa

SEQ ID NO: 544 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged adenosine
  MOD_RES (3)..(3): May be a 2 prime O, 4 prime C methylene bridged cytidine
  MOD_RES (9)..(9): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged adenosine
  MOD_RES (14)..(14): May be a 2 prime O, 4 prime C methylene bridged adenosine
gacttgatcagcaa

SEQ ID NO: 545 - DNA, 14 bp, Homo sapiens
gcattccaggtcct

SEQ ID NO: 546 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged cytidine
  MOD_RES (3)..(3): May be a 2 prime O, 4 prime C methylene bridged adenosine
  MOD_RES (6)..(6): May be a 2 prime O methyl deoxycytidine
  MOD_RES (7)..(7): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged cytidine
  MOD_RES (14)..(14): May be a 2 prime O, 4 prime C methylene bridged thymidine
gcattccaggtcct

SEQ ID NO: 547 - DNA, 14 bp, Homo sapiens
agcattccaggtcc

SEQ ID NO: 548 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged guanosine
  MOD_RES (3)..(3): May be a 2 prime O, 4 prime C methylene bridged cytidine
  MOD_RES (7)..(7): May be a 2 prime O methyl deoxycytidine
  MOD_RES (8)..(8): May be a 2 prime O methyl deoxycytidine
  MOD_RES (12)..(12): May be a 2 prime O, 4 prime C methylene bridged thymidine
  MOD_RES (13)..(13): May be a 2 prime O, 4 prime C methylene bridged cytidine
  MOD_RES (14)..(14): May be a 2 prime O, 4 prime C methylene bridged cytidine
agcattccaggtcc

SEQ ID NO: 549 - DNA, 14 bp, Homo sapiens
ggagcattccaggt

SEQ ID NO: 550 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged guanosine
  MOD_RES (3)..(3): May be a 2 prime O, 4 prime C methylene bridged adenosine
  MOD_RES (5)..(5): May be a 2 prime O methyl deoxycytidine
  MOD_RES (9)..(9): May be a 2 prime O methyl deoxycytidine
  MOD_RES (10)..(10): May be a 2 prime O methyl deoxycytidine
  MOD_RES (12)..(12): May be a 2 prime O, 4 prime C methylene bridged guanosine
  MOD_RES (13)..(13): May be a 2 prime O, 4 prime C methylene bridged guanosine
  MOD_RES (14)..(14): May be a 2 prime O, 4 prime C methylene bridged thymidine
ggagcattccaggt

SEQ ID NO: 551 - DNA, 14 bp, Homo sapiens
gggagcattccagg

SEQ ID NO: 552 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged guanosine
  MOD_RES (3)..(3): May be a 2 prime O, 4 prime C methylene bridged guanosine
  MOD_RES (6)..(6): May be a 2 prime O methyl deoxycytidine
  MOD_RES (10)..(10): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged adenosine
  MOD_RES (13)..(13): May be a 2 prime O, 4 prime C methylene bridged guanosine
  MOD_RES (14)..(14): May be a 2 prime O, 4 prime C methylene bridged guanosine
gggagcattccagg

SEQ ID NO: 553 - DNA, 14 bp, Homo sapiens
cagggagcattcca

SEQ ID NO: 554 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (2)..(2): May be a 2 prime O, 4 prime C methylene bridged adenosine
  MOD_RES (3)..(3): May be a 2 prime O, 4 prime C methylene bridged guanosine
  MOD_RES (8)..(8): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged cytidine
  MOD_RES (14)..(14): May be a 2 prime O, 4 prime C methylene bridged adenosine
cagggagcattcca

SEQ ID NO: 555 - DNA, 14 bp, Homo sapiens
caggctcagctggc

SEQ ID NO: 556 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (2)..(2): May be a 2 prime O, 4 prime C methylene bridged adenosine
  MOD_RES (3)..(3): May be a 2 prime O, 4 prime C methylene bridged guanosine
  MOD_RES (5)..(5): May be a 2 prime O methyl deoxycytidine
  MOD_RES (7)..(7): May be a 2 prime O methyl deoxycytidine
  MOD_RES (10)..(10): May be a 2 prime O methyl deoxycytidine
  MOD_RES (12)..(12): May be a 2 prime O, 4 prime C methylene bridged guanosine
  MOD_RES (13)..(13): May be a 2 prime O, 4 prime C methylene bridged guanosine
  MOD_RES (14)..(14): May be a 2 prime O, 4 prime C methylene bridged cytidine
caggctcagctggc

SEQ ID NO: 557 - DNA, 14 bp, Homo sapiens
gcaggctcagctgg

SEQ ID NO: 558 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged cytidine
  MOD_RES (3)..(3): May be a 2 prime O, 4 prime C methylene bridged adenosine
  MOD_RES (6)..(6): May be a 2 prime O methyl deoxycytidine
  MOD_RES (8)..(8): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged thymidine
  MOD_RES (13)..(13): May be a 2 prime O, 4 prime C methylene bridged guanosine
  MOD_RES (14)..(14): May be a 2 prime O, 4 prime C methylene bridged guanosine
gcaggctcagctgg

SEQ ID NO: 559 - DNA, 14 bp, Homo sapiens
gtcagagtctccac

SEQ ID NO: 560 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged thymidine
  MOD_RES (3)..(3): May be a 2 prime O, 4 prime C methylene bridged cytidine
  MOD_RES (9)..(9): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged adenosine
  MOD_RES (14)..(14): May be a 2 prime O, 4 prime C methylene bridged cytidine
gtcagagtctccac

SEQ ID NO: 561 - DNA, 14 bp, Homo sapiens
ggtcagagtctcca

SEQ ID NO: 562 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged guanosine
  MOD_RES (3)..(3): May be a 2 prime O, 4 prime C methylene bridged thymidine
  MOD_RES (4)..(4): May be a 2 prime O methyl deoxycytidine
  MOD_RES (10)..(10): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged cytidine
  MOD_RES (14)..(14): May be a 2 prime O, 4 prime C methylene bridged adenosine
ggtcagagtctcca

SEQ ID NO: 563 - DNA, 14 bp, Homo sapiens
gggtcagagtctcc

SEQ ID NO: 564 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged guanosine
  MOD_RES (3)..(3): May be a 2 prime O, 4 prime C methylene bridged guanosine
  MOD_RES (5)..(5): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged thymidine
  MOD_RES (13)..(13): May be a 2 prime O, 4 prime C methylene bridged cytidine
  MOD_RES (14)..(14): May be a 2 prime O, 4 prime C methylene bridged cytidine
gggtcagagtctcc

SEQ ID NO: 565 - DNA, 14 bp, Homo sapiens
ttagctgatcctca

SEQ ID NO: 566 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged thymidine
  MOD_RES (3)..(3): May be a 2 prime O, 4 prime C methylene bridged adenosine
  MOD_RES (5)..(5): May be a 2 prime O methyl deoxycytidine
  MOD_RES (10)..(10): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged thymidine
  MOD_RES (13)..(13): May be a 2 prime O, 4 prime C methylene bridged cytidine
  MOD_RES (14)..(14): May be a 2 prime O, 4 prime C methylene bridged adenosine
ttagctgatcctca

SEQ ID NO: 567 - DNA, 14 bp, Homo sapiens
cttagctgatcctc

SEQ ID NO: 568 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (2)..(2): May be a 2 prime O, 4 prime C methylene bridged thymidine
  MOD_RES (3)..(3): May be a 2 prime O, 4 prime C methylene bridged thymidine
  MOD_RES (6)..(6): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged thymidine
  MOD_RES (14)..(14): May be a 2 prime O, 4 prime C methylene bridged cytidine
cttagctgatcctc

SEQ ID NO: 569 - DNA, 14 bp, Homo sapiens
atcagacactcctt

SEQ ID NO: 570 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged thymidine
  MOD_RES (3)..(3): May be a 2 prime O, 4 prime C methylene bridged cytidine
  MOD_RES (7)..(7): May be a 2 prime O methyl deoxycytidine
  MOD_RES (9)..(9): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged thymidine
  MOD_RES (14)..(14): May be a 2 prime O, 4 prime C methylene bridged thymidine
atcagacactcctt

SEQ ID NO: 571 - DNA, 14 bp, Homo sapiens
tgatcagacactcc

SEQ ID NO: 572 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged guanosine
  MOD_RES (3)..(3): May be a 2 prime O, 4 prime C methylene bridged adenosine
  MOD_RES (5)..(5): May be a 2 prime O methyl deoxycytidine
  MOD_RES (9)..(9): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged thymidine
  MOD_RES (13)..(13): May be a 2 prime O, 4 prime C methylene bridged cytidine
  MOD_RES (14)..(14): May be a 2 prime O, 4 prime C methylene bridged cytidine
tgatcagacactcc

SEQ ID NO: 573 - DNA, 14 bp, Homo sapiens
ctgatcagacactc

SEQ ID NO: 574 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (2)..(2): May be a 2 prime O, 4 prime C methylene bridged thymidine
  MOD_RES (3)..(3): May be a 2 prime O, 4 prime C methylene bridged guanosine
  MOD_RES (6)..(6): May be a 2 prime O methyl deoxycytidine
  MOD_RES (10)..(10): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged thymidine
  MOD_RES (14)..(14): May be a 2 prime O, 4 prime C methylene bridged cytidine
ctgatcagacactc

SEQ ID NO: 575 - DNA, 14 bp, Homo sapiens
actgatcagacact

SEQ ID NO: 576 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged cytidine
  MOD_RES (3)..(3): May be a 2 prime O, 4 prime C methylene bridged thymidine
  MOD_RES (7)..(7): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged adenosine
  MOD_RES (13)..(13): May be a 2 prime O, 4 prime C methylene bridged cytidine
  MOD_RES (14)..(14): May be a 2 prime O, 4 prime C methylene bridged thymidine
actgatcagacact

SEQ ID NO: 577 - DNA, 14 bp, Homo sapiens
gactgatcagacac

SEQ ID NO: 578 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged adenosine
  MOD_RES (3)..(3): May be a 2 prime O, 4 prime C methylene bridged cytidine
  MOD_RES (8)..(8): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged adenosine
  MOD_RES (14)..(14): May be a 2 prime O, 4 prime C methylene bridged cytidine
gactgatcagacac

SEQ ID NO: 579 - DNA, 14 bp, Homo sapiens
tgactgatcagaca

SEQ ID NO: 580 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged guanosine
  MOD_RES (3)..(3): May be a 2 prime O, 4 prime C methylene bridged adenosine
  MOD_RES (4)..(4): May be a 2 prime O methyl deoxycytidine
  MOD_RES (9)..(9): May be a 2 prime O methyl deoxycytidine
  MOD_RES (12)..(12): May be a 2 prime O, 4 prime C methylene bridged adenosine
  MOD_RES (13)..(13): May be a 2 prime O, 4 prime C methylene bridged cytidine
  MOD_RES (14)..(14): May be a 2 prime O, 4 prime C methylene bridged adenosine
tgactgatcagaca

SEQ ID NO: 581 - DNA, 14 bp, Homo sapiens
ctgactgatcagac

SEQ ID NO: 582 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (2)..(2): May be a 2 prime O, 4 prime C methylene bridged thymidine
  MOD_RES (3)..(3): May be a 2 prime O, 4 prime C methylene bridged guanosine
  MOD_RES (5)..(5): May be a 2 prime O methyl deoxycytidine
  MOD_RES (10)..(10): May be a 2 prime O methyl deoxycytidine
  MOD_RES (12)..(12): May be a 2 prime O, 4 prime C methylene bridged guanosine
  MOD_RES (13)..(13): May be a 2 prime O, 4 prime C methylene bridged adenosine
  MOD_RES (14)..(14): May be a 2 prime O, 4 prime C methylene bridged cytidine
ctgactgatcagac

SEQ ID NO: 583 - DNA, 14 bp, Homo sapiens
gctgactgatcaga

SEQ ID NO: 584 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged cytidine
  MOD_RES (3)..(3): May be a 2 prime O, 4 prime C methylene bridged thymidine
  MOD_RES (6)..(6): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged adenosine
  MOD_RES (13)..(13): May be a 2 prime O, 4 prime C methylene bridged guanosine
  MOD_RES (14)..(14): May be a 2 prime O, 4 prime C methylene bridged adenosine
gctgactgatcaga

SEQ ID NO: 585 - DNA, 14 bp, Homo sapiens
agctgactgatcag

SEQ ID NO: 586 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged guanosine
  MOD_RES (3)..(3): May be a 2 prime O, 4 prime C methylene bridged cytidine
  MOD_RES (7)..(7): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged adenosine
  MOD_RES (14)..(14): May be a 2 prime O, 4 prime C methylene bridged guanosine
agctgactgatcag

SEQ ID NO: 587 - DNA, 14 bp, Homo sapiens
ctcagctgactgat

SEQ ID NO: 588 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (2)..(2): May be a 2 prime O, 4 prime C methylene bridged thymidine
  MOD_RES (3)..(3): May be a 2 prime O, 4 prime C methylene bridged cytidine
  MOD_RES (6)..(6): May be a 2 prime O methyl deoxycytidine
  MOD_RES (10)..(10): May be a 2 prime O methyl deoxycytidine
  MOD_RES (12)..(12): May be a 2 prime O, 4 prime C methylene bridged guanosine
  MOD_RES (13)..(13): May be a 2 prime O, 4 prime C methylene bridged adenosine
  MOD_RES (14)..(14): May be a 2 prime O, 4 prime C methylene bridged thymidine
ctcagctgactgat

SEQ ID NO: 589 - DNA, 14 bp, Homo sapiens
gctcagctgactga

SEQ ID NO: 590 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged cytidine
  MOD_RES (3)..(3): May be a 2 prime O, 4 prime C methylene bridged thymidine
  MOD_RES (4)..(4): May be a 2 prime O methyl deoxycytidine
  MOD_RES (7)..(7): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged thymidine
  MOD_RES (13)..(13): May be a 2 prime O, 4 prime C methylene bridged guanosine
  MOD_RES (14)..(14): May be a 2 prime O, 4 prime C methylene bridged adenosine
gctcagctgactga

SEQ ID NO: 591 - DNA, 14 bp, Homo sapiens
ggctcagctgactg

SEQ ID NO: 592 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged guanosine
  MOD_RES (3)..(3): May be a 2 prime O, 4 prime C methylene bridged cytidine
  MOD_RES (5)..(5): May be a 2 prime O methyl deoxycytidine
  MOD_RES (8)..(8): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged thymidine
  MOD_RES (14)..(14): May be a 2 prime O, 4 prime C methylene bridged guanosine
ggctcagctgactg

SEQ ID NO: 593 - DNA, 14 bp, Homo sapiens
tcctctgactctgt

SEQ ID NO: 594 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged cytidine
  MOD_RES (3)..(3): May be a 2 prime O, 4 prime C methylene bridged cytidine
  MOD_RES (5)..(5): May be a 2 prime O methyl deoxycytidine
  MOD_RES (9)..(9): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged thymidine
  MOD_RES (13)..(13): May be a 2 prime O, 4 prime C methylene bridged guanosine
  MOD_RES (14)..(14): May be a 2 prime O, 4 prime C methylene bridged thymidine
tcctctgactctgt

SEQ ID NO: 595 - DNA, 14 bp, Homo sapiens
atcctctgactctg

SEQ ID NO: 596 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged thymidine
  MOD_RES (3)..(3): May be a 2 prime O, 4 prime C methylene bridged cytidine
  MOD_RES (4)..(4): May be a 2 prime O methyl deoxycytidine
  MOD_RES (6)..(6): May be a 2 prime O methyl deoxycytidine
  MOD_RES (10)..(10): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged thymidine
  MOD_RES (14)..(14): May be a 2 prime O, 4 prime C methylene bridged guanosine
atcctctgactctg

SEQ ID NO: 597 - DNA, 14 bp, Homo sapiens
catcctctgactct

SEQ ID NO: 598 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (2)..(2): May be a 2 prime O, 4 prime C methylene bridged adenosine
  MOD_RES (3)..(3): May be a 2 prime O, 4 prime C methylene bridged thymidine
  MOD_RES (4)..(4): May be a 2 prime O methyl deoxycytidine
  MOD_RES (5)..(5): May be a 2 prime O methyl deoxycytidine
  MOD_RES (7)..(7): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged thymidine
  MOD_RES (13)..(13): May be a 2 prime O, 4 prime C methylene bridged cytidine
  MOD_RES (14)..(14): May be a 2 prime O, 4 prime C methylene bridged thymidine
catcctctgactct

SEQ ID NO: 599 - DNA, 14 bp, Homo sapiens
acatcctctgactc

SEQ ID NO: 600 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged cytidine
  MOD_RES (3)..(3): May be a 2 prime O, 4 prime C methylene bridged adenosine
  MOD_RES (5)..(5): May be a 2 prime O methyl deoxycytidine
  MOD_RES (6)..(6): May be a 2 prime O methyl deoxycytidine
  MOD_RES (8)..(8): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged thymidine
  MOD_RES (14)..(14): May be a 2 prime O, 4 prime C methylene bridged cytidine
acatcctctgactc

SEQ ID NO: 601 - DNA, 14 bp, Homo sapiens
tacatcctctgact

SEQ ID NO: 602 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged adenosine
  MOD_RES (3)..(3): May be a 2 prime O, 4 prime C methylene bridged cytidine
  MOD_RES (6)..(6): May be a 2 prime O methyl deoxycytidine
  MOD_RES (7)..(7): May be a 2 prime O methyl deoxycytidine
  MOD_RES (9)..(9): May be a 2 prime O methyl deoxycytidine
  MOD_RES (12)..(12): May be a 2 prime O, 4 prime C methylene bridged adenosine
  MOD_RES (13)..(13): May be a 2 prime O, 4 prime C methylene bridged cytidine
  MOD_RES (14)..(14): May be a 2 prime O, 4 prime C methylene bridged thymidine
tacatcctctgact

SEQ ID NO: 603 - DNA, 14 bp, Homo sapiens
ttacatcctctgac

SEQ ID NO: 604 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged thymidine
  MOD_RES (3)..(3): May be a 2 prime O, 4 prime C methylene bridged adenosine
  MOD_RES (4)..(4): May be a 2 prime O methyl deoxycytidine
  MOD_RES (7)..(7): May be a 2 prime O methyl deoxycytidine
  MOD_RES (8)..(8): May be a 2 prime O methyl deoxycytidine
  MOD_RES (10)..(10): May be a 2 prime O methyl deoxycytidine
  MOD_RES (12)..(12): May be a 2 prime O, 4 prime C methylene bridged guanosine
  MOD_RES (13)..(13): May be a 2 prime O, 4 prime C methylene bridged adenosine
  MOD_RES (14)..(14): May be a 2 prime O, 4 prime C methylene bridged cytidine
ttacatcctctgac

SEQ ID NO: 605 - DNA, 14 bp, Homo sapiens
gttacatcctctga

SEQ ID NO: 606 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged thymidine
  MOD_RES (3)..(3): May be a 2 prime O, 4 prime C methylene bridged thymidine
  MOD_RES (5)..(5): May be a 2 prime O methyl deoxycytidine
  MOD_RES (8)..(8): May be a 2 prime O methyl deoxycytidine
  MOD_RES (9)..(9): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged thymidine
  MOD_RES (13)..(13): May be a 2 prime O, 4 prime C methylene bridged guanosine
  MOD_RES (14)..(14): May be a 2 prime O, 4 prime C methylene bridged adenosine
gttacatcctctga

SEQ ID NO: 607 - DNA, 14 bp, Homo sapiens
ggttacatcctctg

SEQ ID NO: 608 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged guanosine
  MOD_RES (3)..(3): May be a 2 prime O, 4 prime C methylene bridged thymidine
  MOD_RES (6)..(6): May be a 2 prime O methyl deoxycytidine
  MOD_RES (9)..(9): May be a 2 prime O methyl deoxycytidine
  MOD_RES (10)..(10): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged thymidine
  MOD_RES (14)..(14): May be a 2 prime O, 4 prime C methylene bridged guanosine
ggttacatcctctg

SEQ ID NO: 609 - DNA, 14 bp, Homo sapiens
gggttacatcctct

SEQ ID NO: 610 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged guanosine
  MOD_RES (3)..(3): May be a 2 prime O, 4 prime C methylene bridged guanosine
  MOD_RES (7)..(7): May be a 2 prime O methyl deoxycytidine
  MOD_RES (10)..(10): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged thymidine
  MOD_RES (13)..(13): May be a 2 prime O, 4 prime C methylene bridged cytidine
  MOD_RES (14)..(14): May be a 2 prime O, 4 prime C methylene bridged thymidine
gggttacatcctct

SEQ ID NO: 611 - DNA, 14 bp, Homo sapiens
agggttacatcctc

SEQ ID NO: 612 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged guanosine
  MOD_RES (3)..(3): May be a 2 prime O, 4 prime C methylene bridged guanosine
  MOD_RES (8)..(8): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged thymidine
  MOD_RES (14)..(14): May be a 2 prime O, 4 prime C methylene bridged cytidine
agggttacatcctc

SEQ ID NO: 613 - DNA, 14 bp, Homo sapiens
cagggttacatcct

SEQ ID NO: 614 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (2)..(2): May be a 2 prime O, 4 prime C methylene bridged adenosine
  MOD_RES (3)..(3): May be a 2 prime O, 4 prime C methylene bridged guanosine
  MOD_RES (9)..(9): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged cytidine
  MOD_RES (14)..(14): May be a 2 prime O, 4 prime C methylene bridged thymidine
cagggttacatcct

SEQ ID NO: 615 - DNA, 14 bp, Homo sapiens
ccagggttacatcc

SEQ ID NO: 616 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (2)..(2): May be a 2 prime O, 4 prime C methylene bridged cytidine
  MOD_RES (3)..(3): May be a 2 prime O, 4 prime C methylene bridged adenosine
  MOD_RES (10)..(10): May be a 2 prime O methyl deoxycytidine
  MOD_RES (12)..(12): May be a 2 prime O, 4 prime C methylene bridged thymidine
  MOD_RES (13)..(13): May be a 2 prime O, 4 prime C methylene bridged cytidine
  MOD_RES (14)..(14): May be a 2 prime O, 4 prime C methylene bridged cytidine
ccagggttacatcc

SEQ ID NO: 617 - DNA, 14 bp, Homo sapiens
gctccagggttaca

SEQ ID NO: 618 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged cytidine
  MOD_RES (3)..(3): May be a 2 prime O, 4 prime C methylene bridged thymidine
  MOD_RES (4)..(4): May be a 2 prime O methyl deoxycytidine
  MOD_RES (5)..(5): May be a 2 prime O methyl deoxycytidine
  MOD_RES (12)..(12): May be a 2 prime O, 4 prime C methylene bridged adenosine
  MOD_RES (13)..(13): May be a 2 prime O, 4 prime C methylene bridged cytidine
  MOD_RES (14)..(14): May be a 2 prime O, 4 prime C methylene bridged adenosine
gctccagggttaca

SEQ ID NO: 619 - DNA, 14 bp, Homo sapiens
agctccagggttac

SEQ ID NO: 620 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged guanosine
  MOD_RES (3)..(3): May be a 2 prime O, 4 prime C methylene bridged cytidine
  MOD_RES (5)..(5): May be a 2 prime O methyl deoxycytidine
  MOD_RES (6)..(6): May be a 2 prime O methyl deoxycytidine
  MOD_RES (12)..(12): May be a 2 prime O, 4 prime C methylene bridged thymidine
  MOD_RES (13)..(13): May be a 2 prime O, 4 prime C methylene bridged adenosine
  MOD_RES (14)..(14): May be a 2 prime O, 4 prime C methylene bridged cytidine
agctccagggttac

SEQ ID NO: 621 - DNA, 14 bp, Homo sapiens
gcagctgctgaggt

SEQ ID NO: 622 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged cytidine
  MOD_RES (3)..(3): May be a 2 prime O, 4 prime C methylene bridged adenosine
  MOD_RES (5)..(5): May be a 2 prime O methyl deoxycytidine
  MOD_RES (8)..(8): May be a 2 prime O methyl deoxycytidine
  MOD_RES (12)..(12): May be a 2 prime O, 4 prime C methylene bridged guanosine
  MOD_RES (13)..(13): May be a 2 prime O, 4 prime C methylene bridged guanosine
  MOD_RES (14)..(14): May be a 2 prime O, 4 prime C methylene bridged thymidine
gcagctgctgaggt

SEQ ID NO: 623 - DNA, 14 bp, Homo sapiens
agcagctgctgagg

SEQ ID NO: 624 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged guanosine
  MOD_RES (3)..(3): May be a 2 prime O, 4 prime C methylene bridged cytidine
  MOD_RES (6)..(6): May be a 2 prime O methyl deoxycytidine
  MOD_RES (9)..(9): May be a 2 prime O methyl deoxycytidine
  MOD_RES (12)..(12): May be a 2 prime O, 4 prime C methylene bridged adenosine
  MOD_RES (13)..(13): May be a 2 prime O, 4 prime C methylene bridged guanosine
  MOD_RES (14)..(14): May be a 2 prime O, 4 prime C methylene bridged guanosine
agcagctgctgagg

SEQ ID NO: 625 - DNA, 14 bp, Homo sapiens
cccttaagggcctc

SEQ ID NO: 626 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (2)..(2): May be a 2 prime O, 4 prime C methylene bridged cytidine
  MOD_RES (3)..(3): May be a 2 prime O, 4 prime C methylene bridged cytidine
  MOD_RES (11)..(11): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged thymidine
  MOD_RES (14)..(14): May be a 2 prime O, 4 prime C methylene bridged cytidine
cccttaagggcctc

SEQ ID NO: 627 - DNA, 14 bp, Homo sapiens
aggcagcaggcact

SEQ ID NO: 628 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (3)..(3): May be a 2 prime O, 4 prime C methylene bridged guanosine
  MOD_RES (5)..(5): May be a 2 prime O, 4 prime C methylene bridged adenosine
  MOD_RES (6)..(6): May be a 2 prime O, 4 prime C methylene bridged guanosine
  MOD_RES (9)..(9): May be a 2 prime O, 4 prime C methylene bridged guanosine
  MOD_RES (11)..(11): May be a 2 prime O, 4 prime C methylene bridged cytidine
  MOD_RES (13)..(13): May be a 2 prime O, 4 prime C methylene bridged cytidine
  MOD_RES (14)..(14): May be a 2 prime O, 4 prime C methylene bridged thymidine
aggcagcaggcact

SEQ ID NO: 629 - DNA, 14 bp, Homo sapiens
tcactcacatccat

SEQ ID NO: 630 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (3)..(3): May be a 2 prime O, 4 prime C methylene bridged adenosine
  MOD_RES (5)..(5): May be a 2 prime O, 4 prime C methylene bridged thymidine
  MOD_RES (6)..(6): May be a 2 prime O, 4 prime C methylene bridged cytidine
  MOD_RES (9)..(9): May be a 2 prime O, 4 prime C methylene bridged adenosine
  MOD_RES (11)..(11): May be a 2 prime O, 4 prime C methylene bridged cytidine
  MOD_RES (13)..(13): May be a 2 prime O, 4 prime C methylene bridged adenosine
  MOD_RES (14)..(14): May be a 2 prime O, 4 prime C methylene bridged thymidine
tcactcacatccat

SEQ ID NO: 631 - DNA, 14 bp, Homo sapiens
actccccaagttca

SEQ ID NO: 632 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (3)..(3): May be a 2 prime O, 4 prime C methylene bridged thymidine
  MOD_RES (5)..(5): May be a 2 prime O, 4 prime C methylene bridged cytidine
  MOD_RES (6)..(6): May be a 2 prime O, 4 prime C methylene bridged cytidine
  MOD_RES (9)..(9): May be a 2 prime O, 4 prime C methylene bridged adenosine
  MOD_RES (11)..(11): May be a 2 prime O, 4 prime C methylene bridged thymidine
  MOD_RES (13)..(13): May be a 2 prime O, 4 prime C methylene bridged cytidine
  MOD_RES (14)..(14): May be a 2 prime O, 4 prime C methylene bridged adenosine
actccccaagttca

SEQ ID NO: 633 - DNA, 14 bp, Homo sapiens
aggcacccagactc

SEQ ID NO: 634 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (3)..(3): May be a 2 prime O, 4 prime C methylene bridged guanosine
  MOD_RES (5)..(5): May be a 2 prime O, 4 prime C methylene bridged adenosine
  MOD_RES (6)..(6): May be a 2 prime O, 4 prime C methylene bridged cytidine
  MOD_RES (9)..(9): May be a 2 prime O, 4 prime C methylene bridged adenosine
  MOD_RES (11)..(11): May be a 2 prime O, 4 prime C methylene bridged adenosine
  MOD_RES (13)..(13): May be a 2 prime O, 4 prime C methylene bridged thymidine
  MOD_RES (14)..(14): May be a 2 prime O, 4 prime C methylene bridged cytidine
aggcacccagactc

SEQ ID NO: 635 - DNA, 14 bp, Homo sapiens
gggttcatgggctg

SEQ ID NO: 636 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (3)..(3): May be a 2 prime O, 4 prime C methylene bridged guanosine
  MOD_RES (5)..(5): May be a 2 prime O, 4 prime C methylene bridged thymidine
  MOD_RES (6)..(6): May be a 2 prime O, 4 prime C methylene bridged cytidine
  MOD_RES (9)..(9): May be a 2 prime O, 4 prime C methylene bridged guanosine
  MOD_RES (11)..(11): May be a 2 prime O, 4 prime C methylene bridged guanosine
  MOD_RES (13)..(13): May be a 2 prime O, 4 prime C methylene bridged thymidine
  MOD_RES (14)..(14): May be a 2 prime O, 4 prime C methylene bridged guanosine
gggttcatgggctg

SEQ ID NO: 637 - DNA, 14 bp, Homo sapiens
atggtgacacagaa

SEQ ID NO: 638 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (3)..(3): May be a 2 prime O, 4 prime C methylene bridged guanosine
  MOD_RES (5)..(5): May be a 2 prime O, 4 prime C methylene bridged thymidine
  MOD_RES (6)..(6): May be a 2 prime O, 4 prime C methylene bridged guanosine
  MOD_RES (9)..(9): May be a 2 prime O, 4 prime C methylene bridged adenosine
  MOD_RES (11)..(11): May be a 2 prime O, 4 prime C methylene bridged adenosine
  MOD_RES (13)..(13): May be a 2 prime O, 4 prime C methylene bridged adenosine
  MOD_RES (14)..(14): May be a 2 prime O, 4 prime C methylene bridged adenosine
atggtgacacagaa

SEQ ID NO: 639 - DNA, 14 bp, Homo sapiens
atcagcatggactg

SEQ ID NO: 640 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (3)..(3): May be a 2 prime O, 4 prime C methylene bridged cytidine
  MOD_RES (5)..(5): May be a 2 prime O, 4 prime C methylene bridged guanosine
  MOD_RES (6)..(6): May be a 2 prime O, 4 prime C methylene bridged cytidine
  MOD_RES (9)..(9): May be a 2 prime O, 4 prime C methylene bridged guanosine
  MOD_RES (11)..(11): May be a 2 prime O, 4 prime C methylene bridged adenosine
  MOD_RES (13)..(13): May be a 2 prime O, 4 prime C methylene bridged thymidine
  MOD_RES (14)..(14): May be a 2 prime O, 4 prime C methylene bridged guanosine
atcagcatggactg

SEQ ID NO: 641 - DNA, 14 bp, Homo sapiens
gcttggtgttaacc

SEQ ID NO: 642 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (3)..(3): May be a 2 prime O, 4 prime C methylene bridged thymidine
  MOD_RES (5)..(5): May be a 2 prime O, 4 prime C methylene bridged guanosine
  MOD_RES (6)..(6): May be a 2 prime O, 4 prime C methylene bridged guanosine
  MOD_RES (9)..(9): May be a 2 prime O, 4 prime C methylene bridged thymidine
  MOD_RES (11)..(11): May be a 2 prime O, 4 prime C methylene bridged adenosine
  MOD_RES (13)..(13): May be a 2 prime O, 4 prime C methylene bridged cytidine
  MOD_RES (14)..(14): May be a 2 prime O, 4 prime C methylene bridged cytidine
gcttggtgttaacc

SEQ ID NO: 643 - DNA, 14 bp, Homo sapiens
tccatggcagggtt

SEQ ID NO: 644 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (3)..(3): May be a 2 prime O, 4 prime C methylene bridged cytidine
  MOD_RES (5)..(5): May be a 2 prime O, 4 prime C methylene bridged thymidine
  MOD_RES (6)..(6): May be a 2 prime O, 4 prime C methylene bridged guanosine
  MOD_RES (9)..(9): May be a 2 prime O, 4 prime C methylene bridged adenosine
  MOD_RES (11)..(11): May be a 2 prime O, 4 prime C methylene bridged guanosine
  MOD_RES (13)..(13): May be a 2 prime O, 4 prime C methylene bridged thymidine
  MOD_RES (14)..(14): May be a 2 prime O, 4 prime C methylene bridged thymidine
tccatggcagggtt

SEQ ID NO: 645 - DNA, 14 bp, Homo sapiens
agatagctgtcaat

SEQ ID NO: 646 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (3)..(3): May be a 2 prime O, 4 prime C methylene bridged adenosine
  MOD_RES (5)..(5): May be a 2 prime O, 4 prime C methylene bridged adenosine
  MOD_RES (6)..(6): May be a 2 prime O, 4 prime C methylene bridged guanosine
  MOD_RES (9)..(9): May be a 2 prime O, 4 prime C methylene bridged guanosine
  MOD_RES (11)..(11): May be a 2 prime O, 4 prime C methylene bridged cytidine
  MOD_RES (13)..(13): May be a 2 prime O, 4 prime C methylene bridged adenosine
  MOD_RES (14)..(14): May be a 2 prime O, 4 prime C methylene bridged thymidine
agatagctgtcaat

SEQ ID NO: 647 - DNA, 14 bp, Homo sapiens
cagaagtggtagtc

SEQ ID NO: 648 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (3)..(3): May be a 2 prime O, 4 prime C methylene bridged guanosine
  MOD_RES (5)..(5): May be a 2 prime O, 4 prime C methylene bridged adenosine
  MOD_RES (6)..(6): May be a 2 prime O, 4 prime C methylene bridged guanosine
  MOD_RES (9)..(9): May be a 2 prime O, 4 prime C methylene bridged guanosine
  MOD_RES (11)..(11): May be a 2 prime O, 4 prime C methylene bridged adenosine
  MOD_RES (13)..(13): May be a 2 prime O, 4 prime C methylene bridged thymidine
  MOD_RES (14)..(14): May be a 2 prime O, 4 prime C methylene bridged cytidine
cagaagtggtagtc

SEQ ID NO: 649 - DNA, 14 bp, Homo sapiens
gctgcagaagtggt

SEQ ID NO: 650 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (3)..(3): May be a 2 prime O, 4 prime C methylene bridged thymidine
  MOD_RES (5)..(5): May be a 2 prime O, 4 prime C methylene bridged cytidine
  MOD_RES (6)..(6): May be a 2 prime O, 4 prime C methylene bridged adenosine
  MOD_RES (9)..(9): May be a 2 prime O, 4 prime C methylene bridged adenosine
  MOD_RES (11)..(11): May be a 2 prime O, 4 prime C methylene bridged thymidine
  MOD_RES (13)..(13): May be a 2 prime O, 4 prime C methylene bridged guanosine
  MOD_RES (14)..(14): May be a 2 prime O, 4 prime C methylene bridged thymidine
gctgcagaagtggt

SEQ ID NO: 651 - DNA, 14 bp, Homo sapiens
atgtccatggcatg

SEQ ID NO: 652 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (3)..(3): May be a 2 prime O, 4 prime C methylene bridged guanosine
  MOD_RES (5)..(5): May be a 2 prime O, 4 prime C methylene bridged cytidine
  MOD_RES (6)..(6): May be a 2 prime O, 4 prime C methylene bridged cytidine
  MOD_RES (9)..(9): May be a 2 prime O, 4 prime C methylene bridged guanosine
  MOD_RES (11)..(11): May be a 2 prime O, 4 prime C methylene bridged cytidine
  MOD_RES (13)..(13): May be a 2 prime O, 4 prime C methylene bridged thymidine
  MOD_RES (14)..(14): May be a 2 prime O, 4 prime C methylene bridged guanosine
atgtccatggcatg

SEQ ID NO: 653 - DNA, 14 bp, Homo sapiens
atcttatagcaggc

SEQ ID NO: 654 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (3)..(3): May be a 2 prime O, 4 prime C methylene bridged cytidine
  MOD_RES (5)..(5): May be a 2 prime O, 4 prime C methylene bridged thymidine
  MOD_RES (6)..(6): May be a 2 prime O, 4 prime C methylene bridged adenosine
  MOD_RES (9)..(9): May be a 2 prime O, 4 prime C methylene bridged guanosine
  MOD_RES (11)..(11): May be a 2 prime O, 4 prime C methylene bridged adenosine
  MOD_RES (13)..(13): May be a 2 prime O, 4 prime C methylene bridged guanosine
  MOD_RES (14)..(14): May be a 2 prime O, 4 prime C methylene bridged cytidine
atcttatagcaggc

SEQ ID NO: 655 - DNA, 14 bp, Homo sapiens
gcactctcagtgcc

SEQ ID NO: 656 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (3)..(3): May be a 2 prime O, 4 prime C methylene bridged adenosine
  MOD_RES (5)..(5): May be a 2 prime O, 4 prime C methylene bridged thymidine
  MOD_RES (6)..(6): May be a 2 prime O, 4 prime C methylene bridged cytidine
  MOD_RES (9)..(9): May be a 2 prime O, 4 prime C methylene bridged adenosine
  MOD_RES (11)..(11): May be a 2 prime O, 4 prime C methylene bridged thymidine
  MOD_RES (13)..(13): May be a 2 prime O, 4 prime C methylene bridged cytidine
  MOD_RES (14)..(14): May be a 2 prime O, 4 prime C methylene bridged cytidine
gcactctcagtgcc

SEQ ID NO: 657 - DNA, 14 bp, Homo sapiens
taggcagccttgtc

SEQ ID NO: 658 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (3)..(3): May be a 2 prime O, 4 prime C methylene bridged guanosine
  MOD_RES (5)..(5): May be a 2 prime O, 4 prime C methylene bridged cytidine
  MOD_RES (6)..(6): May be a 2 prime O, 4 prime C methylene bridged adenosine
  MOD_RES (9)..(9): May be a 2 prime O, 4 prime C methylene bridged cytidine
  MOD_RES (11)..(11): May be a 2 prime O, 4 prime C methylene bridged thymidine
  MOD_RES (13)..(13): May be a 2 prime O, 4 prime C methylene bridged thymidine
  MOD_RES (14)..(14): May be a 2 prime O, 4 prime C methylene bridged cytidine
taggcagccttgtc

SEQ ID NO: 659 - DNA, 14 bp, Homo sapiens
tgaggaggtcccca

SEQ ID NO: 660 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (3)..(3): May be a 2 prime O, 4 prime C methylene bridged adenosine
  MOD_RES (5)..(5): May be a 2 prime O, 4 prime C methylene bridged guanosine
  MOD_RES (6)..(6): May be a 2 prime O, 4 prime C methylene bridged adenosine
  MOD_RES (9)..(9): May be a 2 prime O, 4 prime C methylene bridged thymidine
  MOD_RES (11)..(11): May be a 2 prime O, 4 prime C methylene bridged cytidine
  MOD_RES (13)..(13): May be a 2 prime O, 4 prime C methylene bridged cytidine
  MOD_RES (14)..(14): May be a 2 prime O, 4 prime C methylene bridged adenosine
tgaggaggtcccca

SEQ ID NO: 661 - DNA, 14 bp, Homo sapiens
acactctggccctt

SEQ ID NO: 662 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (3)..(3): May be a 2 prime O, 4 prime C methylene bridged adenosine
  MOD_RES (5)..(5): May be a 2 prime O, 4 prime C methylene bridged thymidine
  MOD_RES (6)..(6): May be a 2 prime O, 4 prime C methylene bridged cytidine
  MOD_RES (9)..(9): May be a 2 prime O, 4 prime C methylene bridged guanosine
  MOD_RES (11)..(11): May be a 2 prime O, 4 prime C methylene bridged cytidine
  MOD_RES (13)..(13): May be a 2 prime O, 4 prime C methylene bridged thymidine
  MOD_RES (14)..(14): May be a 2 prime O, 4 prime C methylene bridged thymidine
acactctggccctt

SEQ ID NO: 663 - DNA, 14 bp, Homo sapiens
acctgctccacact

SEQ ID NO: 664 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (3)..(3): May be a 2 prime O, 4 prime C methylene bridged cytidine
  MOD_RES (5)..(5): May be a 2 prime O, 4 prime C methylene bridged guanosine
  MOD_RES (6)..(6): May be a 2 prime O, 4 prime C methylene bridged cytidine
  MOD_RES (9)..(9): May be a 2 prime O, 4 prime C methylene bridged cytidine
  MOD_RES (11)..(11): May be a 2 prime O, 4 prime C methylene bridged cytidine
  MOD_RES (13)..(13): May be a 2 prime O, 4 prime C methylene bridged cytidine
  MOD_RES (14)..(14): May be a 2 prime O, 4 prime C methylene bridged thymidine
acctgctccacact

SEQ ID NO: 665 - DNA, 14 bp, Homo sapiens
agacaccagccacc

SEQ ID NO: 666 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (3)..(3): May be a 2 prime O, 4 prime C methylene bridged adenosine
  MOD_RES (5)..(5): May be a 2 prime O, 4 prime C methylene bridged adenosine
  MOD_RES (6)..(6): May be a 2 prime O, 4 prime C methylene bridged cytidine
  MOD_RES (9)..(9): May be a 2 prime O, 4 prime C methylene bridged guanosine
  MOD_RES (11)..(11): May be a 2 prime O, 4 prime C methylene bridged cytidine
  MOD_RES (13)..(13): May be a 2 prime O, 4 prime C methylene bridged cytidine
  MOD_RES (14)..(14): May be a 2 prime O, 4 prime C methylene bridged cytidine
agacaccagccacc

SEQ ID NO: 667 - DNA, 14 bp, Homo sapiens
ctcaaagatctcaa

SEQ ID NO: 668 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (3)..(3): May be a 2 prime O, 4 prime C methylene bridged cytidine
  MOD_RES (5)..(5): May be a 2 prime O, 4 prime C methylene bridged adenosine
  MOD_RES (6)..(6): May be a 2 prime O, 4 prime C methylene bridged adenosine
  MOD_RES (9)..(9): May be a 2 prime O, 4 prime C methylene bridged thymidine
  MOD_RES (11)..(11): May be a 2 prime O, 4 prime C methylene bridged thymidine
  MOD_RES (13)..(13): May be a 2 prime O, 4 prime C methylene bridged adenosine
  MOD_RES (14)..(14): May be a 2 prime O, 4 prime C methylene bridged adenosine
ctcaaagatctcaa

SEQ ID NO: 669 - DNA, 14 bp, Homo sapiens
atgaagacccagtc

SEQ ID NO: 670 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (3)..(3): May be a 2 prime O, 4 prime C methylene bridged guanosine
  MOD_RES (5)..(5): May be a 2 prime O, 4 prime C methylene bridged adenosine
  MOD_RES (6)..(6): May be a 2 prime O, 4 prime C methylene bridged guanosine
  MOD_RES (9)..(9): May be a 2 prime O, 4 prime C methylene bridged cytidine
  MOD_RES (11)..(11): May be a 2 prime O, 4 prime C methylene bridged adenosine
  MOD_RES (13)..(13): May be a 2 prime O, 4 prime C methylene bridged thymidine
  MOD_RES (14)..(14): May be a 2 prime O, 4 prime C methylene bridged cytidine
atgaagacccagtc

SEQ ID NO: 671 - DNA, 14 bp, Homo sapiens
cttcttgtcaggcc

SEQ ID NO: 672 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (3)..(3): May be a 2 prime O, 4 prime C methylene bridged thymidine
  MOD_RES (5)..(5): May be a 2 prime O, 4 prime C methylene bridged thymidine
  MOD_RES (6)..(6): May be a 2 prime O, 4 prime C methylene bridged thymidine
  MOD_RES (9)..(9): May be a 2 prime O, 4 prime C methylene bridged cytidine
  MOD_RES (11)..(11): May be a 2 prime O, 4 prime C methylene bridged guanosine
  MOD_RES (13)..(13): May be a 2 prime O, 4 prime C methylene bridged cytidine
  MOD_RES (14)..(14): May be a 2 prime O, 4 prime C methylene bridged cytidine
cttcttgtcaggcc

SEQ ID NO: 673 - DNA, 14 bp, Homo sapiens
tagtggaccacctc

SEQ ID NO: 674 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (3)..(3): May be a 2 prime O, 4 prime C methylene bridged guanosine
  MOD_RES (5)..(5): May be a 2 prime O, 4 prime C methylene bridged guanosine
  MOD_RES (6)..(6): May be a 2 prime O, 4 prime C methylene bridged guanosine
  MOD_RES (9)..(9): May be a 2 prime O, 4 prime C methylene bridged cytidine
  MOD_RES (11)..(11): May be a 2 prime O, 4 prime C methylene bridged cytidine
  MOD_RES (13)..(13): May be a 2 prime O, 4 prime C methylene bridged thymidine
  MOD_RES (14)..(14): May be a 2 prime O, 4 prime C methylene bridged cytidine
tagtggaccacctc

SEQ ID NO: 675 - DNA, 14 bp, Homo sapiens
aggttctccttgtg

SEQ ID NO: 676 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (3)..(3): May be a 2 prime O, 4 prime C methylene bridged guanosine
  MOD_RES (5)..(5): May be a 2 prime O, 4 prime C methylene bridged thymidine
  MOD_RES (6)..(6): May be a 2 prime O, 4 prime C methylene bridged cytidine
  MOD_RES (9)..(9): May be a 2 prime O, 4 prime C methylene bridged cytidine
  MOD_RES (11)..(11): May be a 2 prime O, 4 prime C methylene bridged thymidine
  MOD_RES (13)..(13): May be a 2 prime O, 4 prime C methylene bridged thymidine
  MOD_RES (14)..(14): May be a 2 prime O, 4 prime C methylene bridged guanosine
aggttctccttgtg

SEQ ID NO: 677 - DNA, 14 bp, Homo sapiens
gggctgtgtggccc

SEQ ID NO: 678 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (3)..(3): May be a 2 prime O, 4 prime C methylene bridged guanosine
  MOD_RES (5)..(5): May be a 2 prime O, 4 prime C methylene bridged thymidine
  MOD_RES (6)..(6): May be a 2 prime O, 4 prime C methylene bridged guanosine
  MOD_RES (9)..(9): May be a 2 prime O, 4 prime C methylene bridged thymidine
  MOD_RES (11)..(11): May be a 2 prime O, 4 prime C methylene bridged guanosine
  MOD_RES (13)..(13): May be a 2 prime O, 4 prime C methylene bridged cytidine
  MOD_RES (14)..(14): May be a 2 prime O, 4 prime C methylene bridged cytidine
gggctgtgtggccc

SEQ ID NO: 679 - DNA, 14 bp, Homo sapiens
ccttcctgctgtcc

SEQ ID NO: 680 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (3)..(3): May be a 2 prime O, 4 prime C methylene bridged thymidine
  MOD_RES (5)..(5): May be a 2 prime O, 4 prime C methylene bridged cytidine
  MOD_RES (6)..(6): May be a 2 prime O, 4 prime C methylene bridged cytidine
  MOD_RES (9)..(9): May be a 2 prime O, 4 prime C methylene bridged cytidine
  MOD_RES (11)..(11): May be a 2 prime O, 4 prime C methylene bridged guanosine
  MOD_RES (13)..(13): May be a 2 prime O, 4 prime C methylene bridged cytidine
  MOD_RES (14)..(14): May be a 2 prime O, 4 prime C methylene bridged cytidine
ccttcctgctgtcc

SEQ ID NO: 681 - DNA, 14 bp, Homo sapiens
tggatggtgaacag

SEQ ID NO: 682 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (3)..(3): May be a 2 prime O, 4 prime C methylene bridged guanosine
  MOD_RES (5)..(5): May be a 2 prime O, 4 prime C methylene bridged thymidine
  MOD_RES (6)..(6): May be a 2 prime O, 4 prime C methylene bridged guanosine
  MOD_RES (9)..(9): May be a 2 prime O, 4 prime C methylene bridged guanosine
  MOD_RES (11)..(11): May be a 2 prime O, 4 prime C methylene bridged adenosine
  MOD_RES (13)..(13): May be a 2 prime O, 4 prime C methylene bridged adenosine
  MOD_RES (14)..(14): May be a 2 prime O, 4 prime C methylene bridged guanosine
tggatggtgaacag

SEQ ID NO: 683 - DNA, 14 bp, Homo sapiens
tgcagggccaggtc

SEQ ID NO: 684 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (3)..(3): May be a 2 prime O, 4 prime C methylene bridged cytidine
  MOD_RES (5)..(5): May be a 2 prime O, 4 prime C methylene bridged guanosine
  MOD_RES (6)..(6): May be a 2 prime O, 4 prime C methylene bridged guanosine
  MOD_RES (9)..(9): May be a 2 prime O, 4 prime C methylene bridged cytidine
  MOD_RES (11)..(11): May be a 2 prime O, 4 prime C methylene bridged guanosine
  MOD_RES (13)..(13): May be a 2 prime O, 4 prime C methylene bridged thymidine
  MOD_RES (14)..(14): May be a 2 prime O, 4 prime C methylene bridged cytidine
tgcagggccaggtc

SEQ ID NO: 685 - DNA, 14 bp, Homo sapiens
accttggacttgat

SEQ ID NO: 686 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (3)..(3): May be a 2 prime O, 4 prime C methylene bridged cytidine
  MOD_RES (5)..(5): May be a 2 prime O, 4 prime C methylene bridged thymidine
  MOD_RES (6)..(6): May be a 2 prime O, 4 prime C methylene bridged guanosine
  MOD_RES (9)..(9): May be a 2 prime O, 4 prime C methylene bridged cytidine
  MOD_RES (11)..(11): May be a 2 prime O, 4 prime C methylene bridged thymidine
  MOD_RES (13)..(13): May be a 2 prime O, 4 prime C methylene bridged adenosine
  MOD_RES (14)..(14): May be a 2 prime O, 4 prime C methylene bridged thymidine
accttggacttgat

SEQ ID NO: 687 - DNA, 14 bp, Homo sapiens
gcattccaggtcct

SEQ ID NO: 688 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (3)..(3): May be a 2 prime O, 4 prime C methylene bridged adenosine
  MOD_RES (5)..(5): May be a 2 prime O, 4 prime C methylene bridged thymidine
  MOD_RES (6)..(6): May be a 2 prime O, 4 prime C methylene bridged cytidine
  MOD_RES (9)..(9): May be a 2 prime O, 4 prime C methylene bridged guanosine
  MOD_RES (11)..(11): May be a 2 prime O, 4 prime C methylene bridged thymidine
  MOD_RES (13)..(13): May be a 2 prime O, 4 prime C methylene bridged cytidine
  MOD_RES (14)..(14): May be a 2 prime O, 4 prime C methylene bridged thymidine
gcattccaggtcct

SEQ ID NO: 689 - DNA, 14 bp, Homo sapiens
gcaggctcagctgg

SEQ ID NO: 690 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (3)..(3): May be a 2 prime O, 4 prime C methylene bridged adenosine
  MOD_RES (5)..(5): May be a 2 prime O, 4 prime C methylene bridged guanosine
  MOD_RES (6)..(6): May be a 2 prime O, 4 prime C methylene bridged cytidine
  MOD_RES (9)..(9): May be a 2 prime O, 4 prime C methylene bridged adenosine
  MOD_RES (11)..(11): May be a 2 prime O, 4 prime C methylene bridged cytidine
  MOD_RES (13)..(13): May be a 2 prime O, 4 prime C methylene bridged guanosine
  MOD_RES (14)..(14): May be a 2 prime O, 4 prime C methylene bridged guanosine
gcaggctcagctgg

SEQ ID NO: 691 - DNA, 14 bp, Homo sapiens
ctgcactggccttg

SEQ ID NO: 692 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (3)..(3): May be a 2 prime O, 4 prime C methylene bridged guanosine
  MOD_RES (5)..(5): May be a 2 prime O, 4 prime C methylene bridged adenosine
  MOD_RES (6)..(6): May be a 2 prime O, 4 prime C methylene bridged cytidine
  MOD_RES (9)..(9): May be a 2 prime O, 4 prime C methylene bridged guanosine
  MOD_RES (11)..(11): May be a 2 prime O, 4 prime C methylene bridged cytidine
  MOD_RES (13)..(13): May be a 2 prime O, 4 prime C methylene bridged thymidine
  MOD_RES (14)..(14): May be a 2 prime O, 4 prime C methylene bridged guanosine
ctgcactggccttg

SEQ ID NO: 693 - DNA, 14 bp, Homo sapiens
gcttctctgcactg

SEQ ID NO: 694 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (3)..(3): May be a 2 prime O, 4 prime C methylene bridged thymidine
  MOD_RES (5)..(5): May be a 2 prime O, 4 prime C methylene bridged cytidine
  MOD_RES (6)..(6): May be a 2 prime O, 4 prime C methylene bridged thymidine
  MOD_RES (9)..(9): May be a 2 prime O, 4 prime C methylene bridged guanosine
  MOD_RES (11)..(11): May be a 2 prime O, 4 prime C methylene bridged adenosine
  MOD_RES (13)..(13): May be a 2 prime O, 4 prime C methylene bridged thymidine
  MOD_RES (14)..(14): May be a 2 prime O, 4 prime C methylene bridged guanosine
gcttctctgcactg

SEQ ID NO: 695 - DNA, 14 bp, Homo sapiens
ttgatcttggcctc

SEQ ID NO: 696 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (3)..(3): May be a 2 prime O, 4 prime C methylene bridged guanosine
  MOD_RES (5)..(5): May be a 2 prime O, 4 prime C methylene bridged thymidine
  MOD_RES (6)..(6): May be a 2 prime O, 4 prime C methylene bridged cytidine
  MOD_RES (9)..(9): May be a 2 prime O, 4 prime C methylene bridged guanosine
  MOD_RES (11)..(11): May be a 2 prime O, 4 prime C methylene bridged cytidine
  MOD_RES (13)..(13): May be a 2 prime O, 4 prime C methylene bridged thymidine
  MOD_RES (14)..(14): May be a 2 prime O, 4 prime C methylene bridged cytidine
ttgatcttggcctc

SEQ ID NO: 697 - DNA, 14 bp, Homo sapiens
ctgcagctcctcca

SEQ ID NO: 698 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (3)..(3): May be a 2 prime O, 4 prime C methylene bridged guanosine
  MOD_RES (5)..(5): May be a 2 prime O, 4 prime C methylene bridged adenosine
  MOD_RES (6)..(6): May be a 2 prime O, 4 prime C methylene bridged guanosine
  MOD_RES (9)..(9): May be a 2 prime O, 4 prime C methylene bridged cytidine
  MOD_RES (11)..(11): May be a 2 prime O, 4 prime C methylene bridged thymidine
  MOD_RES (13)..(13): May be a 2 prime O, 4 prime C methylene bridged cytidine
  MOD_RES (14)..(14): May be a 2 prime O, 4 prime C methylene bridged adenosine
ctgcagctcctcca

SEQ ID NO: 699 - DNA, 14 bp, Homo sapiens
tgactgatcagaca

SEQ ID NO: 700 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (3)..(3): May be a 2 prime O, 4 prime C methylene bridged adenosine
  MOD_RES (5)..(5): May be a 2 prime O, 4 prime C methylene bridged thymidine
  MOD_RES (6)..(6): May be a 2 prime O, 4 prime C methylene bridged guanosine
  MOD_RES (9)..(9): May be a 2 prime O, 4 prime C methylene bridged cytidine
  MOD_RES (11)..(11): May be a 2 prime O, 4 prime C methylene bridged guanosine
  MOD_RES (13)..(13): May be a 2 prime O, 4 prime C methylene bridged cytidine
  MOD_RES (14)..(14): May be a 2 prime O, 4 prime C methylene bridged adenosine
tgactgatcagaca

SEQ ID NO: 701 - DNA, 14 bp, Homo sapiens
atggcatctgcttc

SEQ ID NO: 702 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (3)..(3): May be a 2 prime O, 4 prime C methylene bridged guanosine
  MOD_RES (5)..(5): May be a 2 prime O, 4 prime C methylene bridged cytidine
  MOD_RES (6)..(6): May be a 2 prime O, 4 prime C methylene bridged adenosine
  MOD_RES (9)..(9): May be a 2 prime O, 4 prime C methylene bridged thymidine
  MOD_RES (11)..(11): May be a 2 prime O, 4 prime C methylene bridged cytidine
  MOD_RES (13)..(13): May be a 2 prime O, 4 prime C methylene bridged thymidine
  MOD_RES (14)..(14): May be a 2 prime O, 4 prime C methylene bridged cytidine
atggcatctgcttc

SEQ ID NO: 703 - DNA, 14 bp, Homo sapiens
tgcctcctgcagcc

SEQ ID NO: 704 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (3)..(3): May be a 2 prime O, 4 prime C methylene bridged cytidine
  MOD_RES (5)..(5): May be a 2 prime O, 4 prime C methylene bridged thymidine
  MOD_RES (6)..(6): May be a 2 prime O, 4 prime C methylene bridged cytidine
  MOD_RES (9)..(9): May be a 2 prime O, 4 prime C methylene bridged guanosine
  MOD_RES (11)..(11): May be a 2 prime O, 4 prime C methylene bridged adenosine
  MOD_RES (13)..(13): May be a 2 prime O, 4 prime C methylene bridged cytidine
  MOD_RES (14)..(14): May be a 2 prime O, 4 prime C methylene bridged cytidine
tgcctcctgcagcc

SEQ ID NO: 705 - DNA, 14 bp, Homo sapiens
agcttggccttctc

SEQ ID NO: 706 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (3)..(3): May be a 2 prime O, 4 prime C methylene bridged cytidine
  MOD_RES (5)..(5): May be a 2 prime O, 4 prime C methylene bridged thymidine
  MOD_RES (6)..(6): May be a 2 prime O, 4 prime C methylene bridged guanosine
  MOD_RES (9)..(9): May be a 2 prime O, 4 prime C methylene bridged cytidine
  MOD_RES (11)..(11): May be a 2 prime O, 4 prime C methylene bridged thymidine
  MOD_RES (13)..(13): May be a 2 prime O, 4 prime C methylene bridged thymidine
  MOD_RES (14)..(14): May be a 2 prime O, 4 prime C methylene bridged cytidine
agcttggccttctc

SEQ ID NO: 707 - DNA, 14 bp, Homo sapiens
ttacatcctctgac

SEQ ID NO: 708 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (3)..(3): May be a 2 prime O, 4 prime C methylene bridged adenosine
  MOD_RES (5)..(5): May be a 2 prime O, 4 prime C methylene bridged adenosine
  MOD_RES (6)..(6): May be a 2 prime O, 4 prime C methylene bridged thymidine
  MOD_RES (9)..(9): May be a 2 prime O, 4 prime C methylene bridged thymidine
  MOD_RES (11)..(11): May be a 2 prime O, 4 prime C methylene bridged thymidine
  MOD_RES (13)..(13): May be a 2 prime O, 4 prime C methylene bridged adenosine
  MOD_RES (14)..(14): May be a 2 prime O, 4 prime C methylene bridged cytidine
ttacatcctctgac

SEQ ID NO: 709 - DNA, 14 bp, Homo sapiens
agcagctgctgagg

SEQ ID NO: 710 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (3)..(3): May be a 2 prime O, 4 prime C methylene bridged cytidine
  MOD_RES (5)..(5): May be a 2 prime O, 4 prime C methylene bridged guanosine
  MOD_RES (6)..(6): May be a 2 prime O, 4 prime C methylene bridged cytidine
  MOD_RES (9)..(9): May be a 2 prime O, 4 prime C methylene bridged cytidine
  MOD_RES (11)..(11): May be a 2 prime O, 4 prime C methylene bridged guanosine
  MOD_RES (13)..(13): May be a 2 prime O, 4 prime C methylene bridged guanosine
  MOD_RES (14)..(14): May be a 2 prime O, 4 prime C methylene bridged guanosine
agcagctgctgagg

SEQ ID NO: 711 - DNA, 14 bp, Homo sapiens
tctcctcctcctgc

SEQ ID NO: 712 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (3)..(3): May be a 2 prime O, 4 prime C methylene bridged thymidine
  MOD_RES (5)..(5): May be a 2 prime O, 4 prime C methylene bridged cytidine
  MOD_RES (6)..(6): May be a 2 prime O, 4 prime C methylene bridged thymidine
  MOD_RES (9)..(9): May be a 2 prime O, 4 prime C methylene bridged thymidine
  MOD_RES (11)..(11): May be a 2 prime O, 4 prime C methylene bridged cytidine
  MOD_RES (13)..(13): May be a 2 prime O, 4 prime C methylene bridged guanosine
  MOD_RES (14)..(14): May be a 2 prime O, 4 prime C methylene bridged cytidine
tctcctcctcctgc

SEQ ID NO: 713 - DNA, 14 bp, Homo sapiens
cccttaagggcctc

SEQ ID NO: 714 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (3)..(3): May be a 2 prime O, 4 prime C methylene bridged cytidine
  MOD_RES (5)..(5): May be a 2 prime O, 4 prime C methylene bridged thymidine
  MOD_RES (6)..(6): May be a 2 prime O, 4 prime C methylene bridged adenosine
  MOD_RES (9)..(9): May be a 2 prime O, 4 prime C methylene bridged guanosine
  MOD_RES (11)..(11): May be a 2 prime O, 4 prime C methylene bridged cytidine
  MOD_RES (13)..(13): May be a 2 prime O, 4 prime C methylene bridged thymidine
  MOD_RES (14)..(14): May be a 2 prime O, 4 prime C methylene bridged cytidine
cccttaagggcctc

SEQ ID NO: 715 - DNA, 14 bp, Homo sapiens
aggttcttcctgtc

SEQ ID NO: 716 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (3)..(3): May be a 2 prime O, 4 prime C methylene bridged guanosine
  MOD_RES (5)..(5): May be a 2 prime O, 4 prime C methylene bridged thymidine
  MOD_RES (6)..(6): May be a 2 prime O, 4 prime C methylene bridged cytidine
  MOD_RES (9)..(9): May be a 2 prime O, 4 prime C methylene bridged cytidine
  MOD_RES (11)..(11): May be a 2 prime O, 4 prime C methylene bridged thymidine
  MOD_RES (13)..(13): May be a 2 prime O, 4 prime C methylene bridged thymidine
  MOD_RES (14)..(14): May be a 2 prime O, 4 prime C methylene bridged cytidine
aggttcttcctgtc

SEQ ID NO: 717 - DNA, 14 bp, Homo sapiens
gaccttgctctgca

SEQ ID NO: 718 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (3)..(3): May be a 2 prime O, 4 prime C methylene bridged cytidine
  MOD_RES (5)..(5): May be a 2 prime O, 4 prime C methylene bridged thymidine
  MOD_RES (6)..(6): May be a 2 prime O, 4 prime C methylene bridged thymidine
  MOD_RES (9)..(9): May be a 2 prime O, 4 prime C methylene bridged thymidine
  MOD_RES (11)..(11): May be a 2 prime O, 4 prime C methylene bridged thymidine
  MOD_RES (13)..(13): May be a 2 prime O, 4 prime C methylene bridged cytidine
  MOD_RES (14)..(14): May be a 2 prime O, 4 prime C methylene bridged adenosine
gaccttgctctgca

SEQ ID NO: 719 - DNA, 14 bp, Homo sapiens
agctcttgaccttg

SEQ ID NO: 720 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (3)..(3): May be a 2 prime O, 4 prime C methylene bridged cytidine
  MOD_RES (5)..(5): May be a 2 prime O, 4 prime C methylene bridged cytidine
  MOD_RES (6)..(6): May be a 2 prime O, 4 prime C methylene bridged thymidine
  MOD_RES (9)..(9): May be a 2 prime O, 4 prime C methylene bridged adenosine
  MOD_RES (11)..(11): May be a 2 prime O, 4 prime C methylene bridged cytidine
  MOD_RES (13)..(13): May be a 2 prime O, 4 prime C methylene bridged thymidine
  MOD_RES (14)..(14): May be a 2 prime O, 4 prime C methylene bridged guanosine
agctcttgaccttg

SEQ ID NO: 721 - DNA, 14 bp, Homo sapiens
gtgctgggccttgc

SEQ ID NO: 722 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (3)..(3): May be a 2 prime O, 4 prime C methylene bridged guanosine
  MOD_RES (5)..(5): May be a 2 prime O, 4 prime C methylene bridged thymidine
  MOD_RES (6)..(6): May be a 2 prime O, 4 prime C methylene bridged guanosine
  MOD_RES (9)..(9): May be a 2 prime O, 4 prime C methylene bridged cytidine
  MOD_RES (11)..(11): May be a 2 prime O, 4 prime C methylene bridged thymidine
  MOD_RES (13)..(13): May be a 2 prime O, 4 prime C methylene bridged guanosine
  MOD_RES (14)..(14): May be a 2 prime O, 4 prime C methylene bridged cytidine
gtgctgggccttgc

SEQ ID NO: 723 - DNA, 14 bp, Homo sapiens
ttgttggcctgggt

SEQ ID NO: 724 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (3)..(3): May be a 2 prime O, 4 prime C methylene bridged guanosine
  MOD_RES (5)..(5): May be a 2 prime O, 4 prime C methylene bridged thymidine
  MOD_RES (6)..(6): May be a 2 prime O, 4 prime C methylene bridged guanosine
  MOD_RES (9)..(9): May be a 2 prime O, 4 prime C methylene bridged cytidine
  MOD_RES (11)..(11): May be a 2 prime O, 4 prime C methylene bridged guanosine
  MOD_RES (13)..(13): May be a 2 prime O, 4 prime C methylene bridged guanosine
  MOD_RES (14)..(14): May be a 2 prime O, 4 prime C methylene bridged thymidine
ttgttggcctgggt

SEQ ID NO: 725 - DNA, 14 bp, Homo sapiens
cagcttgttggcct

SEQ ID NO: 726 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (3)..(3): May be a 2 prime O, 4 prime C methylene bridged guanosine
  MOD_RES (5)..(5): May be a 2 prime O, 4 prime C methylene bridged thymidine
  MOD_RES (6)..(6): May be a 2 prime O, 4 prime C methylene bridged thymidine
  MOD_RES (9)..(9): May be a 2 prime O, 4 prime C methylene bridged thymidine
  MOD_RES (11)..(11): May be a 2 prime O, 4 prime C methylene bridged guanosine
  MOD_RES (13)..(13): May be a 2 prime O, 4 prime C methylene bridged cytidine
  MOD_RES (14)..(14): May be a 2 prime O, 4 prime C methylene bridged thymidine
cagcttgttggcct

SEQ ID NO: 727 - DNA, 14 bp, Artificial Sequence
  modified nucleotide MYHB7B antisense oligonucleotide
ttgatcttggcctc

SEQ ID NO: 728 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (3)..(3): May be a 2 prime O, 4 prime C methylene bridged guanosine
  MOD_RES (5)..(5): May be a 2 prime O, 4 prime C methylene bridged thymidine
  MOD_RES (6)..(6): May be a 2 prime O, 4 prime C methylene bridged cytidine
  MOD_RES (9)..(9): May be a 2 prime O, 4 prime C methylene bridged guanosine
  MOD_RES (11)..(11): May be a 2 prime O, 4 prime C methylene bridged cytidine
  MOD_RES (13)..(13): May be a 2 prime O, 4 prime C methylene bridged thymidine
  MOD_RES (14)..(14): May be a 2 prime O, 4 prime C methylene bridged cytidine
ttgatcttggcctc

SEQ ID NO: 729 - DNA, 14 bp, Artificial Sequence
  modified nucleotide MYHB7B antisense oligonucleotide
ttgatcttggcctc

SEQ ID NO: 730 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (3)..(3): May be a 2 prime O, 4 prime C methylene bridged guanosine
  MOD_RES (5)..(5): May be a 2 prime O, 4 prime C methylene bridged thymidine
  MOD_RES (7)..(7): May be a 2 prime O, 4 prime C methylene bridged thymidine
  MOD_RES (8)..(8): May be a 2 prime O, 4 prime C methylene bridged thymidine
  MOD_RES (9)..(9): May be a 2 prime O, 4 prime C methylene bridged guanosine
  MOD_RES (12)..(12): May be a 2 prime O, 4 prime C methylene bridged cytidine
  MOD_RES (14)..(14): May be a 2 prime O, 4 prime C methylene bridged cytidine
ttgatcttggcctc

SEQ ID NO: 731 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged thymidine
  MOD_RES (3)..(3): May be a 2 prime O, 4 prime C methylene bridged guanosine
  MOD_RES (6)..(6): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged thymidine
  MOD_RES (14)..(14): May be a 2 prime O, 4 prime C methylene bridged cytidine
ttgatcttggcctc

SEQ ID NO: 732 - DNA, 14 bp, Artificial Sequence
  modified nucleotide MYHB7B antisense oligonucleotide
ttgatcttggcctc

SEQ ID NO: 733 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C ethylene bridged thymidine
  MOD_RES (2)..(2): May be a 2 prime O, 4 prime C ethylene bridged thymidine
  MOD_RES (3)..(3): May be a 2 prime O, 4 prime C ethylene bridged guanosine
  MOD_RES (6)..(6): May be a 2 prime O methyl deoxycytidine
  MOD_RES (11)..(11): May be a 2 prime O methyl deoxycytidine
  MOD_RES (12)..(12): May be a 2 prime O, 4 prime C ethylene bridged cytidine
  MOD_RES (13)..(13): May be a 2 prime O, 4 prime C ethylene bridged thymidine
  MOD_RES (14)..(14): May be a 2 prime O, 4 prime C ethylene bridged cytidine
ttgatcttggcctc

SEQ ID NO: 734 - DNA, 14 bp, Artificial Sequence
  modified nucleotide MYHB7B antisense oligonucleotide
ttgatcttggcctc

SEQ ID NO: 735 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged thymidine
  MOD_RES (3)..(3): May be a 2 prime O methyl guanosine
  MOD_RES (6)..(6): May be a 2 prime O methyl deoxycytidine
  MOD_RES (11)..(11): May be a 2 prime O methyl deoxycytidine
  MOD_RES (12)..(12): May be a 2 prime O methyl cytidine
  MOD_RES (13)..(13): May be a 2 prime O, 4 prime C methylene bridged thymidine
  MOD_RES (14)..(14): May be a 2 prime O, 4 prime C methylene bridged cytidine
ttgatcttggcctc

SEQ ID NO: 736 - DNA, 14 bp, Artificial Sequence
  modified nucleotide MYHB7B antisense oligonucleotide
ttgatcttggcctc

SEQ ID NO: 737 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C ethylene bridged thymidine
  MOD_RES (2)..(2): May be a 2 prime O, 4 prime C ethylene bridged thymidine
  MOD_RES (3)..(3): May be a 2 prime O, 4 prime C methylene bridged guanosine
  MOD_RES (6)..(6): May be a 2 prime O methyl deoxycytidine
  MOD_RES (11)..(11): May be a 2 prime O methyl deoxycytidine
  MOD_RES (12)..(12): May be a 2 prime O, 4 prime C ethylene bridged cytidine
  MOD_RES (13)..(13): May be a 2 prime O, 4 prime C ethylene bridged thymidine
  MOD_RES (14)..(14): May be a 2 prime O, 4 prime C ethylene bridged cytidine
ttgatcttggcctc

SEQ ID NO: 738 - DNA, 14 bp, Artificial Sequence
  modified nucleotide MYHB7B antisense oligonucleotide
ttgatcttggcctc

SEQ ID NO: 739 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C ethylene bridged thymidine
  MOD_RES (2)..(2): May be a 2 prime O, 4 prime C methylene bridged thymidine
  MOD_RES (3)..(3): May be a 2 prime O, 4 prime C methylene bridged guanosine
  MOD_RES (6)..(6): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged thymidine
  MOD_RES (14)..(14): May be a 2 prime O, 4 prime C methylene bridged cytidine
ttgatcttggcctc

SEQ ID NO: 740 - DNA, 14 bp, Artificial Sequence
  modified nucleotide MYHB7B antisense oligonucleotide
ttgatcttggcctc

SEQ ID NO: 741 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C ethylene bridged thymidine
  MOD_RES (3)..(3): May be a 2 prime O, 4 prime C methylene bridged guanosine
  MOD_RES (6)..(6): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged thymidine
  MOD_RES (14)..(14): May be a 2 prime O, 4 prime C methylene bridged cytidine
ttgatcttggcctc

SEQ ID NO: 742 - DNA, 14 bp, Artificial Sequence
  modified nucleotide MYHB7B antisense oligonucleotide
ttgatcttggcctc

SEQ ID NO: 743 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged thymidine
  MOD_RES (3)..(3): May be a 2 prime O, 4 prime C ethylene bridged guanosine
  MOD_RES (6)..(6): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged thymidine
  MOD_RES (14)..(14): May be a 2 prime O, 4 prime C methylene bridged cytidine
ttgatcttggcctc

SEQ ID NO: 744 - DNA, 14 bp, Artificial Sequence
  modified nucleotide MYHB7B antisense oligonucleotide
ttgatcttggcctc

SEQ ID NO: 745 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged thymidine
  MOD_RES (3)..(3): May be a 2 prime O, 4 prime C methylene bridged guanosine
  MOD_RES (6)..(6): May be a 2 prime O methyl deoxycytidine
  MOD_RES (11)..(11): May be a 2 prime O methyl deoxycytidine
  MOD_RES (12)..(12): May be a 2 prime O, 4 prime C ethylene bridged cytidine
  MOD_RES (13)..(13): May be a 2 prime O, 4 prime C methylene bridged thymidine
  MOD_RES (14)..(14): May be a 2 prime O, 4 prime C methylene bridged cytidine
ttgatcttggcctc

SEQ ID NO: 746 - DNA, 14 bp, Artificial Sequence
  modified nucleotide MYHB7B antisense oligonucleotide
ttgatcttggcctc

SEQ ID NO: 747 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged thymidine
  MOD_RES (3)..(3): May be a 2 prime O, 4 prime C methylene bridged guanosine
  MOD_RES (6)..(6): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C ethylene bridged thymidine
  MOD_RES (14)..(14): May be a 2 prime O, 4 prime C methylene bridged cytidine
ttgatcttggcctc

SEQ ID NO: 748 - DNA, 14 bp, Artificial Sequence
  modified nucleotide MYHB7B antisense oligonucleotide
ttgatcttggcctc

SEQ ID NO: 749 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged thymidine
  MOD_RES (3)..(3): May be a 2 prime O, 4 prime C methylene bridged guanosine
  MOD_RES (6)..(6): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged thymidine
  MOD_RES (14)..(14): May be a 2 prime O, 4 prime C ethylene bridged cytidine
ttgatcttggcctc

SEQ ID NO: 750 - DNA, 14 bp, Artificial Sequence
  modified nucleotide MYHB7B antisense oligonucleotide
ttgatcttggcctc

SEQ ID NO: 751 - DNA, 14 bp, Artificial Sequence
  modified nucleotide MYHB7B antisense oligonucleotide
  MISC_FEATURE (1)..(3): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged thymidine
  MOD_RES (3)..(3): May be a 2 prime O, 4 prime C methylene bridged guanosine
  MOD_RES (6)..(6): May be a 2 prime O methyl deoxycytidine
  MOD_RES (11)..(11): May be a 2 prime O methyl deoxycytidine
  MISC_FEATURE (12)..(14): May be joined through phosphorothioate bonds
  MOD_RES (12)..(12): May be a 2 prime O, 4 prime C methylene bridged cytidine
  MOD_RES (13)..(13): May be a 2 prime O, 4 prime C methylene bridged thymidine
  MOD_RES (14)..(14): May be a 2 prime O, 4 prime C methylene bridged cytidine
ttgatcttggcctc

SEQ ID NO: 752 - DNA, 14 bp, Artificial Sequence
  modified nucleotide MYHB7B antisense oligonucleotide
ttgatcttggcctc

SEQ ID NO: 753 - DNA, 14 bp, Artificial Sequence
  modified nucleotide MYHB7B antisense oligonucleotide
  MISC_FEATURE (1)..(4): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged thymidine
  MOD_RES (3)..(3): May be a 2 prime O, 4 prime C methylene bridged guanosine
  MOD_RES (6)..(6): May be a 2 prime O methyl deoxycytidine
  MISC_FEATURE (11)..(14): May be joined through phosphorothioate bonds
  MOD_RES (11)..(11): May be a 2 prime O methyl deoxycytidine
  MOD_RES (12)..(12): May be a 2 prime O, 4 prime C methylene bridged cytidine
  MOD_RES (13)..(13): May be a 2 prime O, 4 prime C methylene bridged thymidine
  MOD_RES (14)..(14): May be a 2 prime O, 4 prime C methylene bridged cytidine
ttgatcttggcctc

SEQ ID NO: 754 - DNA, 14 bp, Artificial Sequence
  modified nucleotide MYHB7B antisense oligonucleotide
ttgatcttggcctc

SEQ ID NO: 755 - DNA, 14 bp, Artificial Sequence
  modified nucleotide MYHB7B antisense oligonucleotide
  MISC_FEATURE (1)..(3): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged thymidine
  MOD_RES (3)..(3): May be a 2 prime O, 4 prime C methylene bridged guanosine
  MISC_FEATURE (4)..(5): May be joined through phosphorothioate bonds
  MISC_FEATURE (6)..(7): May be joined through phosphorothioate bonds
  MOD_RES (6)..(6): May be a 2 prime O methyl deoxycytidine
  MISC_FEATURE (8)..(9): May be joined through phosphorothioate bonds
  MISC_FEATURE (10)..(11): May be joined through phosphorothioate bonds
  MOD_RES (11)..(11): May be a 2 prime O methyl deoxycytidine
  MISC_FEATURE (12)..(14): May be joined through phosphorothioate bonds
  MOD_RES (12)..(12): May be a 2 prime O, 4 prime C methylene bridged cytidine
  MOD_RES (13)..(13): May be a 2 prime O, 4 prime C methylene bridged thymidine
  MOD_RES (14)..(14): May be a 2 prime O, 4 prime C methylene bridged cytidine
ttgatcttggcctc

SEQ ID NO: 756 - DNA, 14 bp, Artificial Sequence
  modified nucleotide MYHB7B antisense oligonucleotide
ttgatcttggcctc

SEQ ID NO: 757 - DNA, 14 bp, Artificial Sequence
  modified nucleotide MYHB7B antisense oligonucleotide
  MISC_FEATURE (1)..(2): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged thymidine
  MISC_FEATURE (3)..(4): May be joined through phosphorothioate bonds
  MOD_RES (3)..(3): May be a 2 prime O, 4 prime C methylene bridged guanosine
  MISC_FEATURE (5)..(6): May be joined through phosphorothioate bonds
  MOD_RES (6)..(6): May be a 2 prime O methyl deoxycytidine
  MISC_FEATURE (7)..(8): May be joined through phosphorothioate bonds
  MISC_FEATURE (9)..(10): May be joined through phosphorothioate bonds
  MISC_FEATURE (11)..(12): May be joined through phosphorothioate bonds
  MOD_RES (11)..(11): May be a 2 prime O methyl deoxycytidine
  MOD_RES (12)..(12): May be a 2 prime O, 4 prime C methylene bridged cytidine
  MISC_FEATURE (13)..(14): May be joined through phosphorothioate bonds
  MOD_RES (13)..(13): May be a 2 prime O, 4 prime C methylene bridged thymidine
  MOD_RES (14)..(14): May be a 2 prime O, 4 prime C methylene bridged cytidine
ttgatcttggcctc

SEQ ID NO: 758 - DNA, 14 bp, Artificial Sequence
  modified nucleotide MYHB7B antisense oligonucleotide
ttgatcttggcctc

SEQ ID NO: 759 - DNA, 14 bp, Artificial Sequence
  modified nucleotide MYHB7B antisense oligonucleotide
  MISC_FEATURE (1)..(3): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged thymidine
  MOD_RES (3)..(3): May be a 2 prime O, 4 prime C methylene bridged guanosine
  MISC_FEATURE (4)..(7): May be joined through phosphorothioate bonds
  MOD_RES (6)..(6): May be a 2 prime O methyl deoxycytidine
  MISC_FEATURE (8)..(11): May be joined through phosphorothioate bonds
  MOD_RES (11)..(11): May be a 2 prime O methyl deoxycytidine
  MISC_FEATURE (12)..(14): May be joined through phosphorothioate bonds
  MOD_RES (12)..(12): May be a 2 prime O, 4 prime C methylene bridged cytidine
  MOD_RES (13)..(13): May be a 2 prime O, 4 prime C methylene bridged thymidine
  MOD_RES (14)..(14): May be a 2 prime O, 4 prime C methylene bridged cytidine
ttgatcttggcctc

SEQ ID NO: 760 - DNA, 14 bp, Artificial Sequence
  modified nucleotide MYHB7B antisense oligonucleotide
ctgcagctcctcca

SEQ ID NO: 761 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (2)..(2): May be a 2 prime O, 4 prime C methylene bridged thymidine
  MOD_RES (3)..(3): May be a 2 prime O methyl guanosine
  MOD_RES (4)..(4): May be a 2 prime O methyl deoxycytidine
  MOD_RES (7)..(7): May be a 2 prime O methyl deoxycytidine
  MOD_RES (9)..(9): May be a 2 prime O methyl deoxycytidine
  MOD_RES (10)..(10): May be a 2 prime O methyl deoxycytidine
  MOD_RES (12)..(12): May be a 2 prime O methyl cytidine
  MOD_RES (13)..(13): May be a 2 prime O, 4 prime C methylene bridged cytidine
  MOD_RES (14)..(14): May be a 2 prime O, 4 prime C methylene bridged adenosine
ctgcagctcctcca

SEQ ID NO: 762 - DNA, 14 bp, Artificial Sequence
  modified nucleotide MYHB7B antisense oligonucleotide
ctgcagctcctcca

SEQ ID NO: 763 - DNA, 14 bp, Artificial Sequence
  modified nucleotide MYHB7B antisense oligonucleotide
  MISC_FEATURE (1)..(3): May be joined through phosphorothioate bonds
  MOD_RES (1)..(1): May be a 2 prime O, 4 prime C methylene bridged cytidine
  MOD_RES (2)..(2): May be a 2 prime O, 4 prime C methylene bridged thymidine
  MOD_RES (3)..(3): May be a 2 prime O, 4 prime C methylene bridged guanosine
  MISC_FEATURE (4)..(5): May be joined through phosphorothioate bonds
  MOD_RES (4)..(4): May be a 2 prime O methyl deoxycytidine
  MISC_FEATURE (6)..(7): May be joined through phosphorothioate bonds
  MOD_RES (7)..(7): May be a 2 prime O methyl deoxycytidine
  MISC_FEATURE (8)..(9): May be joined through phosphorothioate bonds
  MOD_RES (9)..(9): May be a 2 prime O methyl deoxycytidine
  MISC_FEATURE (10)..(11): May be joined through phosphorothioate bonds
  MOD_RES (10)..(10): May be a 2 prime O methyl deoxycytidine
  MISC_FEATURE (12)..(14): May be joined through phosphorothioate bonds
  MOD_RES (12)..(12): May be a 2 prime O, 4 prime C methylene bridged cytidine
  MOD_RES (13)..(13): May be a 2 prime O, 4 prime C methylene bridged cytidine
  MOD_RES (14)..(14): May be a 2 prime O, 4 prime C methylene bridged adenosine
ctgcagctcctcca

SEQ ID NO: 764 - DNA, 14 bp, Artificial Sequence
  modified nucleotide MYHB7B antisense oligonucleotide
ctgcagctcctcca

SEQ ID NO: 765 - DNA, 14 bp, Artificial Sequence
  modified nucleotide MYHB7B antisense oligonucleotide
  MISC_FEATURE (1)..(3): May be joined through phosphorothioate bonds
  MOD_RES (1)..(1): May be a 2 prime O, 4 prime C methylene bridged cytidine
  MOD_RES (2)..(2): May be a 2 prime O, 4 prime C methylene bridged thymidine
  MOD_RES (3)..(3): May be a 2 prime O, 4 prime C methylene bridged guanosine
  MISC_FEATURE (4)..(7): May be joined through phosphorothioate bonds
  MOD_RES (4)..(4): May be a 2 prime O methyl deoxycytidine
  MOD_RES (7)..(7): May be a 2 prime O methyl deoxycytidine
  MISC_FEATURE (8)..(11): May be joined through phosphorothioate bonds
  MOD_RES (9)..(9): May be a 2 prime O methyl deoxycytidine
  MOD_RES (10)..(10): May be a 2 prime O methyl deoxycytidine
  MISC_FEATURE (12)..(14): May be joined through phosphorothioate bonds
  MOD_RES (12)..(12): May be a 2 prime O, 4 prime C methylene bridged cytidine
  MOD_RES (13)..(13): May be a 2 prime O, 4 prime C methylene bridged cytidine
  MOD_RES (14)..(14): May be a 2 prime O, 4 prime C methylene bridged adenosine
ctgcagctcctcca

SEQ ID NO: 766 - DNA, 14 bp, Artificial Sequence
  modified nucleotide MYHB7B antisense oligonucleotide
ttgatcttggcctc

SEQ ID NO: 767 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O methyl uridine
  MOD_RES (3)..(3): May be a 2 prime O, 4 prime C methylene bridged guanosine
  MOD_RES (6)..(6): May be a 2 prime O methyl deoxycytidine
  MOD_RES (11)..(11): May be a 2 prime O methyl deoxycytidine
  MOD_RES (12)..(12): May be a 2 prime O, 4 prime C methylene bridged cytidine
  MOD_RES (13)..(13): May be a 2 prime O methyl uridine
  MOD_RES (14)..(14): May be a 2 prime O, 4 prime C methylene bridged cytidine
tugatcttggccuc

SEQ ID NO: 768 - DNA, 14 bp, Artificial Sequence
  modified nucleotide MYHB7B antisense oligonucleotide
ttgatcttggcctc

SEQ ID NO: 769 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged thymidine
  MOD_RES (3)..(3): May be a 2 prime fluoro guanosine
  MOD_RES (6)..(6): May be a 2 prime O methyl deoxycytidine
  MOD_RES (11)..(11): May be a 2 prime O methyl deoxycytidine
  MOD_RES (12)..(12): May be a 2 prime fluoro cytidine
  MOD_RES (13)..(13): May be a 2 prime O, 4 prime C methylene bridged thymidine
  MOD_RES (14)..(14): May be a 2 prime O, 4 prime C methylene bridged cytidine
ttgatcttggcctc

SEQ ID NO: 770 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged cytidine
  MOD_RES (3)..(3): May be a 2 prime O methyl uridine
  MOD_RES (10)..(10): May be a 2 prime O methyl deoxycytidine
  MOD_RES (12)..(12): May be a 2 prime O methyl uridine
  MOD_RES (13)..(13): May be a 2 prime O, 4 prime C methylene bridged cytidine
  MOD_RES (14)..(14): May be a 2 prime O, 4 prime C methylene bridged thymidine
tcuggatggcauct

SEQ ID NO: 771 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged adenosine
  MOD_RES (3)..(3): May be a 2 prime O methyl cytidine
  MOD_RES (10)..(10): May be a 2 prime O methyl deoxycytidine
  MOD_RES (11)..(11): May be a 2 prime O methyl deoxycytidine
  MOD_RES (12)..(12): May be a 2 prime O methyl adenosine
  MOD_RES (13)..(13): May be a 2 prime O, 4 prime C methylene bridged thymidine
  MOD_RES (14)..(14): May be a 2 prime O, 4 prime C methylene bridged thymidine
gactgggagccatt

SEQ ID NO: 772 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged cytidine
  MOD_RES (2)..(2): May be a 2 prime O, 4 prime C methylene bridged cytidine
  MOD_RES (3)..(3): May be a 2 prime O methyl adenosine
  MOD_RES (8)..(8): May be a 2 prime O methyl deoxycytidine
  MOD_RES (9)..(9): May be a 2 prime O methyl deoxycytidine
  MOD_RES (12)..(12): May be a 2 prime O methyl uridine
  MOD_RES (13)..(13): May be a 2 prime O, 4 prime C methylene bridged thymidine
  MOD_RES (14)..(14): May be a 2 prime O, 4 prime C methylene bridged cytidine
ccaggagcctautc

SEQ ID NO: 773 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged guanosine
  MOD_RES (3)..(3): May be a 2 prime O methyl adenosine
  MOD_RES (4)..(4): May be a 2 prime O methyl deoxycytidine
  MOD_RES (10)..(10): May be a 2 prime O methyl deoxycytidine
  MOD_RES (12)..(12): May be a 2 prime O methyl guanosine
  MOD_RES (13)..(13): May be a 2 prime O, 4 prime C methylene bridged cytidine
  MOD_RES (14)..(14): May be a 2 prime O, 4 prime C methylene bridged adenosine
agacagaagcagca

SEQ ID NO: 774 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged guanosine
  MOD_RES (3)..(3): May be a 2 prime O methyl uridine
  MOD_RES (5)..(5): May be a 2 prime O methyl deoxycytidine
  MOD_RES (7)..(7): May be a 2 prime O methyl deoxycytidine
  MOD_RES (9)..(9): May be a 2 prime O methyl deoxycytidine
  MOD_RES (11)..(11): May be a 2 prime O methyl deoxycytidine
  MOD_RES (12)..(12): May be a 2 prime O methyl adenosine
  MOD_RES (13)..(13): May be a 2 prime O, 4 prime C methylene bridged thymidine
  MOD_RES (14)..(14): May be a 2 prime O, 4 prime C methylene bridged cytidine
agutcactcacatc

SEQ ID NO: 775 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged adenosine
  MOD_RES (3)..(3): May be a 2 prime O methyl adenosine
  MOD_RES (7)..(7): May be a 2 prime O methyl deoxycytidine
  MOD_RES (12)..(12): May be a 2 prime O methyl guanosine
  MOD_RES (13)..(13): May be a 2 prime O, 4 prime C methylene bridged guanosine
  MOD_RES (14)..(14): May be a 2 prime O, 4 prime C methylene bridged guanosine
aaagtgcaggaggg

SEQ ID NO: 776 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged cytidine
  MOD_RES (3)..(3): May be a 2 prime O methyl cytidine
  MOD_RES (5)..(5): May be a 2 prime O methyl deoxycytidine
  MOD_RES (11)..(11): May be a 2 prime O methyl deoxycytidine
  MOD_RES (12)..(12): May be a 2 prime O methyl uridine
  MOD_RES (13)..(13): May be a 2 prime O, 4 prime C methylene bridged thymidine
  MOD_RES (14)..(14): May be a 2 prime O, 4 prime C methylene bridged guanosine
tcctcagggtcutg

SEQ ID NO: 777 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged thymidine
  MOD_RES (3)..(3): May be a 2 prime O methyl uridine
  MOD_RES (4)..(4): May be a 2 prime O methyl deoxycytidine
  MOD_RES (6)..(6): May be a 2 prime O methyl deoxycytidine
  MOD_RES (8)..(8): May be a 2 prime O methyl deoxycytidine
  MOD_RES (10)..(10): May be a 2 prime O methyl deoxycytidine
  MOD_RES (12)..(12): May be a 2 prime O methyl uridine
  MOD_RES (13)..(13): May be a 2 prime O, 4 prime C methylene bridged cytidine
  MOD_RES (14)..(14): May be a 2 prime O, 4 prime C methylene bridged cytidine
gtucactcacaucc

SEQ ID NO: 778 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged thymidine
  MOD_RES (3)..(3): May be a 2 prime O methyl cytidine
  MOD_RES (5)..(5): May be a 2 prime O methyl deoxycytidine
  MOD_RES (7)..(7): May be a 2 prime O methyl deoxycytidine
  MOD_RES (9)..(9): May be a 2 prime O methyl deoxycytidine
  MOD_RES (12)..(12): May be a 2 prime O methyl cytidine
  MOD_RES (13)..(13): May be a 2 prime O, 4 prime C methylene bridged cytidine
  MOD_RES (14)..(14): May be a 2 prime O, 4 prime C methylene bridged adenosine
ttcactcacatcca

SEQ ID NO: 779 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged guanosine
  MOD_RES (3)..(3): May be a 2 prime O methyl uridine
  MOD_RES (5)..(5): May be a 2 prime O methyl deoxycytidine
  MOD_RES (11)..(11): May be a 2 prime O methyl deoxycytidine
  MOD_RES (12)..(12): May be a 2 prime O methyl adenosine
  MOD_RES (13)..(13): May be a 2 prime O, 4 prime C methylene bridged guanosine
  MOD_RES (14)..(14): May be a 2 prime O, 4 prime C methylene bridged adenosine
ggutcatagacaga

SEQ ID NO: 780 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged thymidine
  MOD_RES (3)..(3): May be a 2 prime O methyl uridine
  MOD_RES (4)..(4): May be a 2 prime O methyl deoxycytidine
  MOD_RES (5)..(5): May be a 2 prime O methyl deoxycytidine
  MOD_RES (7)..(7): May be a 2 prime O methyl deoxycytidine
  MOD_RES (12)..(12): May be a 2 prime O methyl uridine
  MOD_RES (13)..(13): May be a 2 prime O, 4 prime C methylene bridged cytidine
  MOD_RES (14)..(14): May be a 2 prime O, 4 prime C methylene bridged thymidine
atucctcaggguct

SEQ ID NO: 781 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged thymidine
  MOD_RES (2)..(2): May be a 2 prime O, 4 prime C methylene bridged cytidine
  MOD_RES (3)..(3): May be a 2 prime O methyl adenosine
  MOD_RES (4)..(4): May be a 2 prime O methyl deoxycytidine
  MOD_RES (6)..(6): May be a 2 prime O methyl deoxycytidine
  MOD_RES (8)..(8): May be a 2 prime O methyl deoxycytidine
  MOD_RES (11)..(11): May be a 2 prime O methyl deoxycytidine
  MOD_RES (12)..(12): May be a 2 prime O methyl cytidine
  MOD_RES (13)..(13): May be a 2 prime O, 4 prime C methylene bridged adenosine
  MOD_RES (14)..(14): May be a 2 prime O, 4 prime C methylene bridged thymidine
tcactcacatccat

SEQ ID NO: 782 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged guanosine
  MOD_RES (3)..(3): May be a 2 prime O methyl uridine
  MOD_RES (7)..(7): May be a 2 prime O methyl deoxycytidine
  MOD_RES (11)..(11): May be a 2 prime O methyl deoxycytidine
  MOD_RES (12)..(12): May be a 2 prime O methyl cytidine
  MOD_RES (13)..(13): May be a 2 prime O, 4 prime C methylene bridged thymidine
  MOD_RES (14)..(14): May be a 2 prime O, 4 prime C methylene bridged cytidine
agutatcattcctc

SEQ ID NO: 783 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged thymidine
  MOD_RES (3)..(3): May be a 2 prime O methyl uridine
  MOD_RES (6)..(6): May be a 2 prime O methyl deoxycytidine
  MOD_RES (10)..(10): May be a 2 prime O methyl deoxycytidine
  MOD_RES (11)..(11): May be a 2 prime O methyl deoxycytidine
  MOD_RES (12)..(12): May be a 2 prime O methyl uridine
  MOD_RES (13)..(13): May be a 2 prime O, 4 prime C methylene bridged cytidine
  MOD_RES (14)..(14): May be a 2 prime O, 4 prime C methylene bridged adenosine
gtuatcattccuca

SEQ ID NO: 784 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime O, 4 prime C methylene bridged adenosine
  MOD_RES (2)..(2): May be a 2 prime O, 4 prime C methylene bridged cytidine
  MOD_RES (3)..(3): May be a 2 prime O methyl uridine
  MOD_RES (4)..(4): May be a 2 prime O methyl deoxycytidine
  MOD_RES (6)..(6): May be a 2 prime O methyl deoxycytidine
  MOD_RES (11)..(11): May be a 2 prime O methyl deoxycytidine
  MOD_RES (12)..(12): May be a 2 prime O methyl cytidine
  MOD_RES (13)..(13): May be a 2 prime O, 4 prime C methylene bridged adenosine
  MOD_RES (14)..(14): May be a 2 prime O, 4 prime C methylene bridged thymidine
acuctcagtgccat

SEQ ID NO: 785 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime CH2-NH-CH2 4 prime bridged thymidine
  MOD_RES (2)..(2): May be a 2 prime CH2-NH-CH2 4 prime bridged thymidine
  MOD_RES (3)..(3): May be a 2 prime CH2-NH-CH2 4 prime bridged guanosine
  MOD_RES (6)..(6): May be a 2 prime O methyl deoxycytidine
  MOD_RES (11)..(11): May be a 2 prime O methyl deoxycytidine
  MOD_RES (12)..(12): May be a 2 prime CH2-NH-CH2 4 prime bridged cytidine
  MOD_RES (13)..(13): May be a 2 prime CH2-NH-CH2 4 prime bridged thymidine
  MOD_RES (14)..(14): May be a 2 prime CH2-NH-CH2 4 prime bridged cytidine
ttgatcttggcctc

SEQ ID NO: 786 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime CH2-NH-CH2 4 prime bridged guanosine
  MOD_RES (2)..(2): May be a 2 prime CH2-NH-CH2 4 prime bridged cytidine
  MOD_RES (3)..(3): May be a 2 prime CH2-NH-CH2 4 prime bridged adenosine
  MOD_RES (12)..(12): May be a 2 prime CH2-NH-CH2 4 prime bridged thymidine
  MOD_RES (13)..(13): May be a 2 prime CH2-NH-CH2 4 prime bridged thymidine
  MOD_RES (14)..(14): May be a 2 prime CH2-NH-CH2 4 prime bridged guanosine
gcaccttggacttg

SEQ ID NO: 787 - DNA, 14 bp, Artificial Sequence
  modified nucleotide MYHB7B antisense oligonucleotide
  MISC_FEATURE (1)..(14): May be joined through phosphorothioate bonds
  MOD_RES (1)..(1): May be a 2 prime CH2-NH-CH2 4 prime bridged thymidine
  MOD_RES (2)..(2): May be a 2 prime CH2-NH-CH2 4 prime bridged guanosine
  MOD_RES (3)..(3): May be a 2 prime CH2-NH-CH2 4 prime bridged adenosine
  MOD_RES (12)..(12): May be a 2 prime CH2-NH-CH2 4 prime bridged thymidine
  MOD_RES (13)..(13): May be a 2 prime CH2-NH-CH2 4 prime bridged thymidine
  MOD_RES (14)..(14): May be a 2 prime CH2-NH-CH2 4 prime bridged guanosine
tgaggttctccttg

SEQ ID NO: 788 - protein, 20 aa, Unknown
  peptide with high selectivity for cardiomyocytes in vivo
WLSEAGPVVTVRALRGTGSW

SEQ ID NO: 789 - DNA, 15 bp, Artificial Sequence
  modified nucleotide MYHB7B antisense oligonucleotide
  MISC_FEATURE (1)..(15): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged thymidine
  MOD_RES (13)..(13): May be a 2 prime O, 4 prime C methylene bridged guanosine
  MOD_RES (14)..(14): May be a 2 prime O, 4 prime C methylene bridged adenosine
  MOD_RES (15)..(15): May be a 2 prime O, 4 prime C methylene bridged adenosine
gtgaatgcggatgaa

SEQ ID NO: 790 - DNA, 15 bp, Artificial Sequence
  modified nucleotide MYHB7B antisense oligonucleotide
  MISC_FEATURE (1)..(15): May be joined through phosphorothioate bonds
  MOD_RES (1)..(1): May be a 2 prime O, 4 prime C methylene bridged guanosine
  MOD_RES (2)..(2): May be a 2 prime O, 4 prime C methylene bridged adenosine
  MOD_RES (3)..(3): May be a 2 prime O, 4 prime C methylene bridged adenosine
  MOD_RES (14)..(14): May be a 2 prime O, 4 prime C methylene bridged thymidine
  MOD_RES (15)..(15): May be a 2 prime O, 4 prime C methylene bridged adenosine
gaagtggtagtcata

SEQ ID NO: 791 - DNA, 15 bp, Artificial Sequence
  modified nucleotide MYHB7B antisense oligonucleotide
  MISC_FEATURE (1)..(15): May be joined through phosphorothioate bonds
  MOD_RES (1)..(1): May be a 2 prime O, 4 prime C methylene bridged guanosine
  MOD_RES (3)..(3): May be a 2 prime O, 4 prime C methylene bridged guanosine
  MOD_RES (6)..(6): May be a 2 prime O, 4 prime C methylene bridged thymidine
  MOD_RES (7)..(7): May be a 2 prime O, 4 prime C methylene bridged guanosine
  MOD_RES (10)..(10): May be a 2 prime O, 4 prime C methylene bridged guanosine
  MOD_RES (12)..(12): May be a 2 prime O, 4 prime C methylene bridged thymidine
  MOD_RES (14)..(14): May be a 2 prime O, 4 prime C methylene bridged adenosine
  MOD_RES (15)..(15): May be a 2 prime O, 4 prime C methylene bridged adenosine
gtgaatgcggatgaa

SEQ ID NO: 792 - DNA, 15 bp, Artificial Sequence
  modified nucleotide MYHB7B antisense oligonucleotide
  MISC_FEATURE (1)..(15): May be joined through phosphorothioate bonds
  MOD_RES (1)..(1): May be a 2 prime O, 4 prime C methylene bridged guanosine
  MOD_RES (3)..(3): May be a 2 prime O, 4 prime C methylene bridged adenosine
  MOD_RES (6)..(6): May be a 2 prime O, 4 prime C methylene bridged guanosine
  MOD_RES (7)..(7): May be a 2 prime O, 4 prime C methylene bridged guanosine
  MOD_RES (10)..(10): May be a 2 prime O, 4 prime C methylene bridged guanosine
  MOD_RES (12)..(12): May be a 2 prime O, 4 prime C methylene bridged cytidine
  MOD_RES (14)..(14): May be a 2 prime O, 4 prime C methylene bridged thymidine
  MOD_RES (15)..(15): May be a 2 prime O, 4 prime C methylene bridged adenosine
gaagtggtagtcata

The invention claimed is:

1. An antisense oligonucleotide inhibitor of MYH7B containing at least one modified nucleotide, wherein the antisense oligonucleotide is 8 to 18 nucleotides and wherein the sequence of the antisense oligonucleotide is completely complementary to a sequence of SEQ ID NO: 6 from nucleotides 4300-4317, nucleotides 4302-4315, or nucleotides 4318-4331.

2. The antisense oligonucleotide inhibitor of claim 1, wherein the antisense oligonucleotide is 14 nucleotides and the sequence of the antisense oligonucleotide is completely complementary to a sequence of SEQ ID NO: 6 from nucleotides 4300-4317.

3. The antisense oligonucleotide inhibitor of claim 1, wherein the antisense oligonucleotide is 14 nucleotides and the sequence of the antisense oligonucleotide is completely complementary to the sequence of SEQ ID NO: 6 from nucleotides 4302-4315.

4. The antisense oligonucleotide inhibitor of claim 1, wherein the antisense oligonucleotide is 14 nucleotides and the sequence of the antisense oligonucleotide is completely complementary to the sequence of SEQ ID NO: 6 from nucleotides 4318-4331.

5. The antisense oligonucleotide inhibitor of claim 1, wherein said modified nucleotide includes a sugar, base, or a backbone modification.

6. The antisense oligonucleotide inhibitor of claim 5, wherein the sugar modification is selected from the group consisting of 2'-O, 4'-C methylene bridge, 2'-O, 4'-C ethylene bridge, 2'-CH$_2$—NH—CH$_2$-4' bridge, 2'-deoxy, 2'-O-alkyl, and 2'-halo modifications.

7. The antisense oligonucleotide inhibitor of claim 5, wherein the backbone modification is a phosphorothioate linkage.

8. The antisense oligonucleotide inhibitor of claim 7, wherein said antisense oligonucleotide contains two or more phosphorothioate linkages.

9. The antisense oligonucleotide inhibitor of claim 8, wherein said antisense oligonucleotide is fully phosphorothioate linked.

10. The antisense oligonucleotide inhibitor of claim 1, wherein said modified nucleotide is a locked nucleotide.

11. The antisense oligonucleotide inhibitor of claim 1, wherein said antisense oligonucleotide contains one to six locked nucleotides.

12. The antisense oligonucleotide inhibitor of claim 1, wherein said antisense oligonucleotide contains at least three locked nucleotides at the 5' end.

13. The antisense oligonucleotide inhibitor of claim 12, wherein the at least three locked nucleotides at the 5' end are ribonucleotides.

14. The antisense oligonucleotide inhibitor of claim 1, wherein said antisense oligonucleotide contains at least three locked nucleotides at the 3' end.

15. The antisense oligonucleotide inhibitor of claim 14, wherein the at least three locked nucleotides at the 3' end are ribonucleotides.

16. The antisense oligonucleotide inhibitor of claim 1, wherein said antisense oligonucleotide contains at least one deoxyribonucleotide.

17. The antisense oligonucleotide inhibitor of claim 16, wherein said antisense oligonucleotide contains two to eight deoxyribonucleotides.

18. The antisense oligonucleotide inhibitor of claim 1, wherein said modified nucleotide is 5'-methyl cytidine.

19. A pharmaceutical composition comprising the antisense oligonucleotide inhibitor of MYH7B of claim 1 and a pharmaceutically acceptable excipient.

20. The pharmaceutical composition of claim 19, further comprising a second therapeutic agent, wherein the second therapeutic agent is an antisense oligonucleotide inhibitor of miR-208a, miR-208b, miR-499, miR-15a, miR-15b, miR-16, miR-195, or a mixture thereof.

21. An antisense oligonucleotide inhibitor of MYH7B containing at least one modified nucleotide, and wherein said antisense oligonucleotide comprises a sequence selected from Tables 1-5.

22. The antisense oligonucleotide inhibitor of claim 21, wherein said antisense oligonucleotide comprises the sequence of 5'-lTslTslGsdAsdTsdCsdTsdTsdGsdGsdCslCslTslC-3' (SEQ ID NO: 146) or 5' -lCslTslGsdCsdAsdGsdCsdTsdCsdCsdTslCslCslA-3' (SEQ ID NO: 148).

23. The antisense oligonucleotide inhibitor of claim 21, wherein said antisense oligonucleotide comprises the sequence of 5'-lCslCslAsdGsdGsdAsdGsmdCsmdCsdTsdAslTslTslC-3' (SEQ ID NO: 494).

24. The antisense oligonucleotide inhibitor of claim 21, wherein said antisense oligonucleotide comprises the sequence of 5'-lGslTslTsmdCsdAsmdCsdTsmdCsdAsmdCsdAslTslCslC-3' (SEQ ID NO: 188).

25. The antisense oligonucleotide inhibitor of claim 21, wherein said antisense oligonucleotide comprises the sequence of 5'-lAslGslTsdTsmdCsdAsmdCsdTsmdCsdAsmdCslAslTslC-3' (SEQ ID NO: 190).

26. The antisense oligonucleotide inhibitor of claim 21, wherein said antisense oligonucleotide comprises the sequence of 5'-lAslGslTsdTsdAsdTsmdCsdAsdTsdTsmdCslCslTslC-3' (SEQ ID NO: 370).

27. The antisense oligonucleotide inhibitor of claim 21, wherein said antisense oligonucleotide comprises the sequence of 5'-lCslTslTsdAsdGsmdCsdTsdGsdAsdTsmdCslCslTslC-3' (SEQ ID NO: 568).

28. A pharmaceutical composition comprising the antisense oligonucleotide inhibitor of MYH7B of claim 21 and a pharmaceutically acceptable excipient.

29. The pharmaceutical composition of claim 28, further comprising a second therapeutic agent, wherein the second therapeutic agent is an antisense oligonucleotide inhibitor of miR-208a, miR-208b, miR-499, miR-15a, miR-15b, miR-16, miR-195, or a mixture thereof.

* * * * *